United States Patent
Bremel et al.

(10) Patent No.: US 11,640,847 B2
(45) Date of Patent: *May 2, 2023

(54) BIOINFORMATIC PROCESSES FOR DETERMINATION OF PEPTIDE BINDING

(71) Applicant: IOGENETICS, LLC, Madison, WI (US)

(72) Inventors: Robert D. Bremel, Hillpoint, WI (US); Jane Homan, Hillpoint, WI (US)

(73) Assignee: IOGENETICS, LLC, Madison, WI (US)

( * ) Notice: Subject to any disclaimer, the term of this patent is extended or adjusted under 35 U.S.C. 154(b) by 337 days.

This patent is subject to a terminal disclaimer.

(21) Appl. No.: 16/921,460

(22) Filed: Jul. 6, 2020

(65) Prior Publication Data

US 2021/0375393 A1    Dec. 2, 2021

Related U.S. Application Data

(63) Continuation of application No. 13/052,733, filed on Mar. 21, 2011, now Pat. No. 10,706,955.

(60) Provisional application No. 61/394,130, filed on Oct. 18, 2010, provisional application No. 61/316,523, filed on Mar. 23, 2010.

(51) Int. Cl.
| | | |
|---|---|---|
| G16B 20/30 | (2019.01) | |
| G16B 20/00 | (2019.01) | |
| G16B 40/20 | (2019.01) | |
| G16B 40/00 | (2019.01) | |
| G16B 20/20 | (2019.01) | |
| G16B 20/40 | (2019.01) | |

(52) U.S. Cl.
CPC ............. *G16B 20/30* (2019.02); *G16B 20/00* (2019.02); *G16B 40/20* (2019.02); *G16B 20/20* (2019.02); *G16B 20/40* (2019.02); *G16B 40/00* (2019.02)

(58) Field of Classification Search
None
See application file for complete search history.

*Primary Examiner* — Michael L Borin
(74) *Attorney, Agent, or Firm* — Casimir Jones S.C.; J. Mitchell Jones

(57) ABSTRACT

This invention relates to the identification of peptide binding to ligands, and in particular to identification of epitopes expressed by microorganisms and by mammalian cells. The present invention provides polypeptides comprising the epitopes, and vaccines, antibodies and diagnostic products that utilize or are developed using the epitopes.

34 Claims, 51 Drawing Sheets

Specification includes a Sequence Listing.

FIG. 1A-E
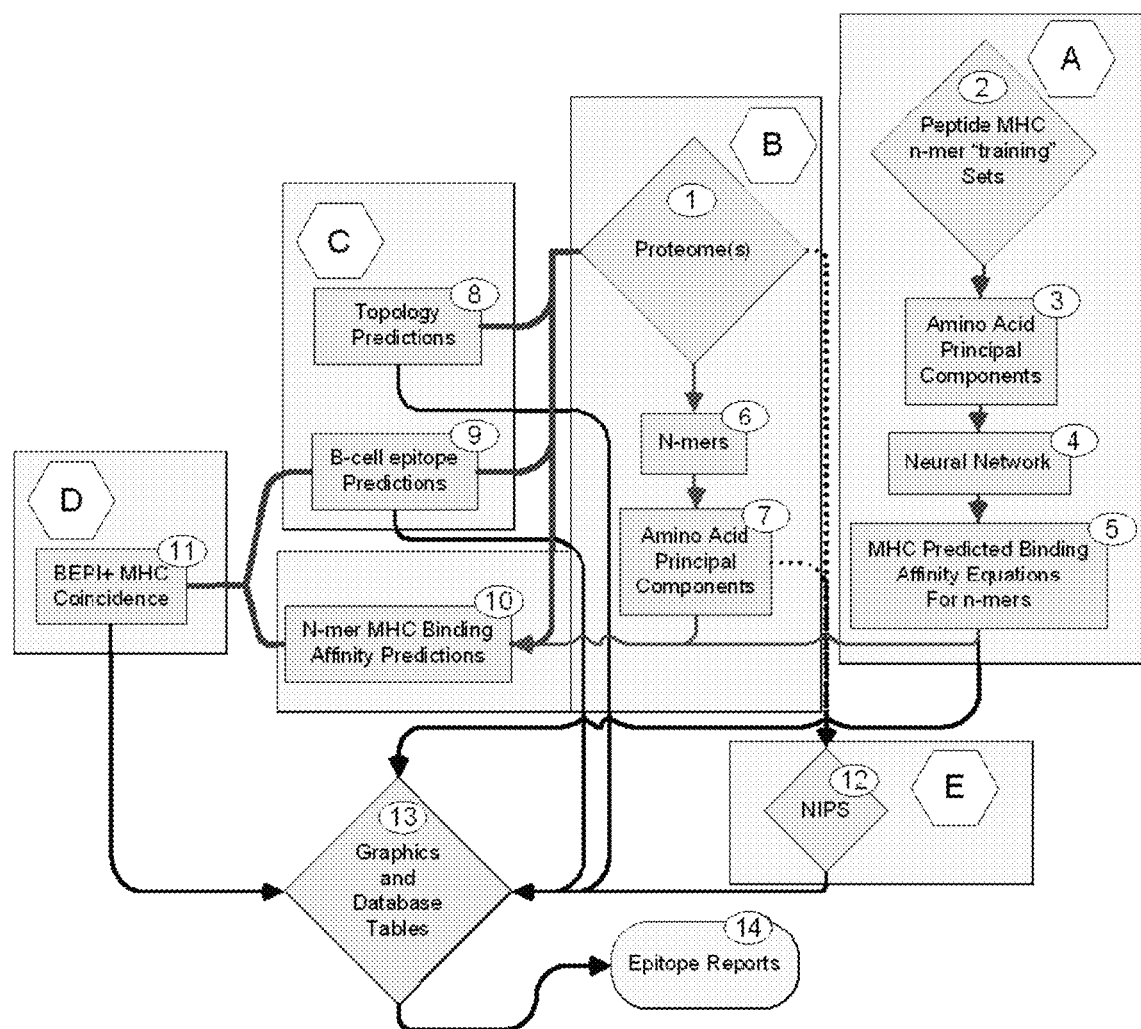

FIG. 2

| Number | Eigenvalue | Percent | 20 40 60 80 | Cum Percent |
|---|---|---|---|---|
| 1 | 22.4846 | 72.531 | | 72.531 |
| 2 | 3.2640 | 10.529 | | 83.060 |
| 3 | 1.9099 | 6.161 | | 89.221 |
| 4 | 0.8802 | 2.840 | | 92.061 |
| 5 | 0.5709 | 1.842 | | 93.902 |
| 6 | 0.5406 | 1.744 | | 95.646 |
| 7 | 0.3022 | 0.975 | | 96.621 |
| 8 | 0.2900 | 0.935 | | 97.556 |
| 9 | 0.2025 | 0.653 | | 98.209 |
| 10 | 0.1594 | 0.514 | | 98.724 |
| 11 | 0.1202 | 0.388 | | 99.111 |
| 12 | 0.0910 | 0.294 | | 99.405 |
| 13 | 0.0754 | 0.243 | | 99.648 |
| 14 | 0.0416 | 0.134 | | 99.782 |
| 15 | 0.0256 | 0.083 | | 99.865 |
| 16 | 0.0199 | 0.064 | | 99.929 |
| 17 | 0.0107 | 0.035 | | 99.964 |
| 18 | 0.0063 | 0.020 | | 99.984 |
| 19 | 0.0049 | 0.016 | | 100.000 |

| Peptide | DRB1_0101 | DRB1_0301 | DRB1_0401 | DRB1_0404 | DRB1_0405 | DRB1_0701 | DRB1_0802 | DRB1_0901 | DRB1_1101 | DRB1_1302 | DRB1_1501 | DRB3_0101 | DRB4_0101 | DRB5_0101 |
|---|---|---|---|---|---|---|---|---|---|---|---|---|---|---|
| 378_NRRGLDLLFWEQGGL | 0.9 | 2,347 | 42 | 80 | 0.5 | 658 | 703 | 153 | 3.7 | 89 | 144 | 14,453 | 98 | 82 |
| 379_RRGLDLLFWEQGGLC | 1.7 | 2,064 | 51 | 85 | 463 | 436 | 5,648 | 3,422 | 4.2 | 50 | 15 | 2,575 | 170 | 11 |
| 380_RGLDLLFWEQGGLCK | 20 | 213 | 1,181 | 1,692 | 400 | 151 | 738 | 130 | 316 | 1,574 | 507 | 43 | 140 | 13 |
| 381_GLDLLFWEQGGLCKA | 38 | 1,205 | 4,145 | 7 | 114 | 78 | 73 | 513 | 14 | 1,584 | 113 | 23,399 | 519 | 805 |
| 382_LDLLFWEQGGLCKAL | 941 | 25 | 42 | 13 | 15 | 10 | 279 | 38 | 4.1 | 413 | 87 | 6,735 | 67 | 48 |
| 383_DLLFWEQGGLCKALQ | 1,814 | 136 | 316 | 1,859 | 127 | 4.6 | 931 | 12 | 2.9 | 995 | 116 | 108 | 61 | 99 |

FIG. 18B

| Peptide | DRB1_0101 | DRB1_0301 | DRB1_0401 | DRB1_0404 | DRB1_0405 | DRB1_0701 | DRB1_0802 | DRB1_0901 | DRB1_1101 | DRB1_1302 | DRB1_1501 | DRB3_0101 | DRB4_0101 | DRB5_0101 |
|---|---|---|---|---|---|---|---|---|---|---|---|---|---|---|
| 382_LDLLFWEQGGLCKAL | 1,814 | 136 | 316 | 1,859 | 127 | 5 | 931 | 12 | 3 | 995 | 116 | 108 | 61 | 99 |
| 383_DLLFWEQGGLCKALQ | 20 | 213 | 1,101 | 1,692 | 400 | 151 | 738 | 130 | 316 | 1,574 | 507 | 43 | 140 | 13 |
| 384_LLFWEQGGLCKALQE | 84 | 295 | 2 | 9 | 12 | 8 | 2,905 | 1,119 | 120 | 2,187 | 31 | 374 | 652 | 4,367 |
| 385_LFWEQGGLCKALQEQ | 81 | 715 | 31 | 415 | 3 | 1 | 2,105 | 8 | 660 | 4,537 | 4,648 | 4,639 | 41,429 | 51 |
| 386_FWEQGGLCKALQEQC | 12,300 | 15 | 7,678 | 11 | 38 | 440 | 196,873 | 119 | 130 | 190 | 172 | 906 | 3,923 | 1,809 |
| 387_WEQGGLCKALQEQCC | 01 | 1,341 | 1,493 | 303 | 36 | 2,060 | 125,554 | 12,782 | 2,203 | 4,111 | 47,441 | 16,569 | 507 | 792 |
| 388_EQGGLCKALQEQCCF | 10 | 679 | 36,393 | 9 | 41 | 388 | 334 | 1,453 | 604 | 10,954 | 1,485 | 6,196 | 614 | 20 |
| 389_QGGLCKALQEQCCFL | 257,721 | 39 | 219 | 13,838 | 36 | 3,021 | | 5,112 | 5,987 | 809 | 27 | 6,257 | 4,370 | 630 |

FIG. 19

| Peptide | DRB1_0101 | DRB1_0301 | DRB1_0401 | DRB1_0404 | DRB1_0405 | DRB1_0701 | DRB1_0802 | DRB1_0901 | DRB1_1101 | DRB1_1302 | DRB1_1501 | DRB3_0101 | DRB4_0101 | DRB5_0101 |
|---|---|---|---|---|---|---|---|---|---|---|---|---|---|---|
| 400_CCFLNITNSHVSILQ | 219 | 11,320 | 5,575 | 2,070 | 28 | 609 | 177 | 3,119 | 1,581 | 26 | 3,996 | 612 | 759 | 3,023 |
| 401_CFLNITNSHVSILQE | 182 | 3,275 | 4,014 | 612 | 376 | 129 | 2,196 | 3,435 | 348 | 221 | 18,948 | 125 | 83 | 213 |
| 402_FLNITNSHVSILQER | 68 | 472 | 8,757 | 33 | 199 | 42 | 650 | 12 | 368 | 1,886 | 3,541 | 2,107 | 4,763 | 93 |
| 403_LNITNSHVSILQERP | 3,036 | 307 | 1,470 | 279 | 1,130 | 115 | 10,003 | 277 | 681 | 31,422 | 617,031 | 20,750 | 4,728 | 3,351 |
| 404_NITNSHVSILQERPP | 4,062 | 374 | 94 | 86 | 272 | 291 | 15,250 | 872 | 44 | 10,644 | 4,301 | 21,286 | 685 | 106 |
| 405_ITNSHVSILQERPPL | 1,542 | 1,739 | 228 | 966 | 878 | 352 | 2,889 | 401 | 809 | 1,251 | 15,290 | 378 | 1,373 | 106 |
| 406_TNSHVSILQERPPLE | 165 | 95 | 1,207 | 2,533 | 2,574 | 242 | 5,175 | 36 | 132 | 359 | 1,205 | 23,913 | 5,111 | 912 |
| 407_NSHVSILQERPPLEN | 87 | 10 | 667 | 7 | 228 | 273 | 186 | 1,242 | 284 | 3,438 | 1,695 | 6,321 | 201 | 29 |
| 408_SHVSILQERPPLENR | 1,984 | 87 | 541 | 6 | 333 | 156 | 231 | 21 | 104 | 433 | 3,888 | 17,345 | 4,089 | 42 |
| 409_HVSILQERPPLENRV | 3,873 | 5,745 | 1,105 | 12,250 | 107 | 3,797 | 5 | 111 | 482 | 6,872 | 521 | 215 | 229 | 859 |
| 410_VSILQERPPLENRVL | 157 | 1,676 | 29 | 1,506 | 90 | 167 | 451 | 4,903 | 76 | 597 | 2,123 | 5,158 | 139 | 27 |
| 411_SILQERPPLENRVLT | 281 | 526 | 3 | 14,007 | 20 | 13 | 4,181 | 661 | 677 | 6,661 | 4,254 | 3,462 | 1,379 | 1,086 |
| 412_ILQERPPLENRVLTG | 82 | 1,036 | 380 | 22 | 324 | 45 | 203 | 7 | 114 | 2,604 | 101 | 2,640 | 20,506 | 12 |

Collagen XVII, known as BP 180 and BPAG2. Mapping is shown for the immediate extramembrane region in the enlarged scale diagram of Figure 2B Collagen VII GI 453699. Red lines indicate regions predicted experimentally to contain epitopes to which autoantibodies bind.
1. Müller R, Dahler et al. *Clin Immunol* 2010, 135:99-107..

FIG. 30

Affinity changes with amino acid mutation.

MHC I

| Classification | Change | number_of_aa_changes | | | | | | | |
|---|---|---|---|---|---|---|---|---|---|
| | | 0 | 1 | 2 | 3 | 4 | 5 | 6 | 7 |
| Lost | Affinity Loss | 0 | 826 | 665 | 522 | 300 | 181 | 69 | 18 |
| | No Change | 1361 | 0 | 0 | 0 | 0 | 0 | 0 | 0 |
| New | Affinity Increase | 0 | 2023 | 1674 | 1282 | 676 | 298 | 104 | 23 |
| | No Change | 1973 | 0 | 0 | 0 | 0 | 0 | 0 | 0 |
| Retained | Affinity Increase | 0 | 10719 | 3956 | 1383 | 592 | 213 | 76 | 22 |
| | Affinity Loss | 0 | 7739 | 3218 | 1319 | 545 | 205 | 39 | 8 |
| | No Change | 33829 | 570 | 205 | 67 | 35 | 12 | 0 | 0 |

MHC II

| Classification | Change | number_of_aa_changes | | | | | | | | |
|---|---|---|---|---|---|---|---|---|---|---|
| | | 0 | 1 | 2 | 3 | 4 | 5 | 6 | 7 | 8 |
| Lost | Affinity Loss | 0 | 65 | 132 | 225 | 113 | 109 | 115 | 40 | 11 |
| New | Affinity Increase | 0 | 225 | 503 | 499 | 411 | 345 | 354 | 130 | 96 |
| Retained | Affinity Increase | 0 | 3780 | 2163 | 849 | 505 | 354 | 165 | 54 | 29 |
| | Affinity Loss | 0 | 4257 | 2003 | 879 | 467 | 318 | 152 | 59 | 17 |
| | No Change | 9587 | 140 | 49 | 12 | 16 | 10 | 1 | 0 | 0 |

FIG. 31A

Tabulate MHC I (Highly mutable region) HK68 -> EN72 Transition

| Classification | Change | Yr Old Cluster | Yr New Cluster | pos | Allele | Old Peptide | New Peptide | Delta Peptide | Delta Pattern | Old Sigma | New Sigma | N |
|---|---|---|---|---|---|---|---|---|---|---|---|---|
| Lost | Affinity Loss | 1968_HK68 | 1972_EN72 | 166 | nB_0702 | RLNWLTKSG | RLNWLYKSE | RLNWL*KS* | '000001001' | -1.07 | 1.72 | 1 |
| | | | | | nB_0801 | RLNWLTKSG | RLNWLYKSE | RLNWL*KS* | '000001001' | -1.23 | 1.2 | 1 |
| | | | | 168 | nA_0202 | NWLTKSGST | NWLYKSECT | NWL*KS**T | '000100110' | -1.48 | 0.3 | 1 |
| | | | | 169 | nA_2402 | WLTKSGSTY | WLYKSECTY | WL*KS**TY | '001001100' | -3 | 0.86 | 1 |
| | | | | | nB_1501 | WLTKSGSTY | WLYKSECTY | WL*KS**TY | '001001100' | -2.04 | 0.53 | 1 |
| | | | | | nB_3501 | WLTKSGSTY | WLYKSECTY | WL*KS**TY | '001001100' | -1.85 | 0.86 | 1 |
| | | | | | nB_4001 | WLTKSGSTY | WLYKSECTY | WL*KS**TY | '001001100' | -1.01 | 0.97 | 1 |
| | | | | | nB_4002 | WLTKSGSTY | WLYKSECTY | WL*KS**TY | '001001100' | -1.27 | 0.34 | 1 |
| | | | | | nB_5101 | WLTKSGSTY | WLYKSECTY | WL*KS**TY | '001001100' | -1.04 | 0.24 | 1 |
| | | | | 171 | nA_2601 | TKSGSTYPV | YKSECTYPV | *KS**TYPV | '100110000' | -2.63 | 1.02 | 1 |
| | | | | | nB_5101 | TKSGSTYPV | YKSECTYPV | *KS**TYPV | '100110000' | -1.45 | 0.54 | 1 |
| | | | | 172 | nB_4002 | KSGSTYPVL | KSECTYPVQ | KS**TYPV* | '001100001' | -1.75 | 0.52 | 1 |
| | | | | | nB_4402 | KSGSTYPVL | KSECTYPVQ | KS**TYPV* | '001100001' | -1.18 | 1.2 | 1 |
| | | | | 174 | nB_3501 | GSTYPVLNV | ECTYPVQNV | **TYPV*NV | '110000100' | -1.08 | 0.24 | 1 |
| New | Affinity Increase | 1968_HK68 | 1972_EN72 | 166 | nA_1101 | RLNWLTKSG | RLNWLYKSE | RLNWL*KS* | '000001001' | 1.48 | -1.37 | 1 |
| | | | | | nA_2902 | RLNWLTKSG | RLNWLYKSE | RLNWL*KS* | '000001001' | -0.89 | -2.6 | 1 |
| | | | | | nA_3001 | RLNWLTKSG | RLNWLYKSE | RLNWL*KS* | '000001001' | 0.53 | -1.65 | 1 |
| | | | | | nA_6801 | RLNWLTKSG | RLNWLYKSE | RLNWL*KS* | '000001001' | -0.27 | -1.64 | 1 |
| | | | | | nB_5301 | RLNWLTKSG | RLNWLYKSE | RLNWL*KS* | '000001001' | 0.31 | -1.51 | 1 |
| | | | | 167 | nA_0201 | LNWLTKSGS | LNWLYKSEC | LNWL*KS** | '000010011' | -0.67 | -1.92 | 1 |
| | | | | | nA_0206 | LNWLTKSGS | LNWLYKSEC | LNWL*KS** | '000010011' | -0.44 | -1.66 | 1 |
| | | | | | nA_0301 | LNWLTKSGS | LNWLYKSEC | LNWL*KS** | '000010011' | -0.33 | -1.52 | 1 |
| | | | | | nA_2402 | LNWLTKSGS | LNWLYKSEC | LNWL*KS** | '000010011' | 0.06 | -1.27 | 1 |
| | | | | | nA_2403 | LNWLTKSGS | LNWLYKSEC | LNWL*KS** | '000010011' | -1.49 | -2.74 | 1 |
| | | | | | nB_1501 | LNWLTKSGS | LNWLYKSEC | LNWL*KS** | '000010011' | -1.3 | -2.56 | 1 |
| | | | | | nB_1801 | LNWLTKSGS | LNWLYKSEC | LNWL*KS** | '000010011' | 0.1 | -1.02 | 1 |
| | | | | | nB_4001 | LNWLTKSGS | LNWLYKSEC | LNWL*KS** | '000010011' | 0.64 | -1.5 | 1 |
| | | | | | nB_5101 | LNWLTKSGS | LNWLYKSEC | LNWL*KS** | '000010011' | -0.11 | -1.5 | 1 |
| | | | | 168 | nA_1101 | NWLTKSGST | NWLYKSECT | NWL*KS**T | '000100110' | -0.31 | -2.36 | 1 |
| | | | | | nA_3002 | NWLTKSGST | NWLYKSECT | NWL*KS**T | '000100110' | 1.31 | -1.07 | 1 |
| | | | | | nB_5801 | NWLTKSGST | NWLYKSECT | NWL*KS**T | '000100110' | -0.42 | -1.54 | 1 |
| | | | | 169 | nB_0702 | WLTKSGSTY | WLYKSECTY | WL*KS**TY | '001001100' | 0.2 | -1.54 | 1 |
| | | | | 170 | nB_4002 | LTKSGSTYP | LYKSECTYP | L*KS**TYP | '010011000' | 0 | -1.18 | 1 |
| | | | | 171 | nA_0203 | TKSGSTYPV | YKSECTYPV | *KS**TYPV | '100110000' | 0.19 | -1.5 | 1 |
| | | | | | nB_4403 | TKSGSTYPV | YKSECTYPV | *KS**TYPV | '100110000' | -1.51 | -2.86 | 1 |
| | | | | | nB_4501 | TKSGSTYPV | YKSECTYPV | *KS**TYPV | '100110000' | -0.26 | -1.59 | 1 |
| | | | | 172 | nA_2601 | KSGSTYPVL | KSECTYPVQ | KS**TYPV* | '001100001' | -0.57 | -2.54 | 1 |
| | | | | | nB_0801 | KSGSTYPVL | KSECTYPVQ | KS**TYPV* | '001100001' | 0.22 | -3.22 | 1 |
| | | | | 173 | nB_0702 | SGSTYPVLN | SECTYPVQN | S**TYPV*N | '011000010' | 0.37 | -1.92 | 1 |
| | | | | | nB_2705 | SGSTYPVLN | SECTYPVQN | S**TYPV*N | '011000010' | -0.01 | -2.2 | 1 |
| | | | | | nB_3501 | SGSTYPVLN | SECTYPVQN | S**TYPV*N | '011000010' | 0.17 | -1.4 | 1 |
| | | | | | nB_5101 | SGSTYPVLN | SECTYPVQN | S**TYPV*N | '011000010' | -0.67 | -1.85 | 1 |
| | | | | | nB_5401 | SGSTYPVLN | SECTYPVQN | S**TYPV*N | '011000010' | 0.75 | -1.42 | 1 |

FIG. 31B

| Classification | Change | Yr Old Cluster | Yr New Cluster | pos | Allele | Old Peptide | New Peptide | Delta Peptide | Delta Pattern | Old Sigma | New Sigma | N |
|---|---|---|---|---|---|---|---|---|---|---|---|---|
| Retained | Affinity Increase | 1968_HK68 | 1972_EN72 | 166 | nA_3301 | RLNWLTKSG | RLNWLYKSE | RLNWL*KS* | '000001001' | -1.85 | -1.92 | 1 |
| | | | | 167 | nA_2301 | LNWLTKSGS | LNWLYKSEC | LNWL*KS** | '000010011' | -1.36 | -1.67 | 1 |
| | | | | | nA_2403 | LNWLTKSGS | LNWLYKSEC | LNWL*KS** | '000010011' | -1.49 | -2.74 | 1 |
| | | | | | nB_1501 | LNWLTKSGS | LNWLYKSEC | LNWL*KS** | '000010011' | -1.3 | -2.56 | 1 |
| | | | | 168 | nA_2403 | NWLTKSGST | NWLYKSECT | NWL*KS**T | '000100110' | -1.62 | -1.94 | 1 |
| | | | | 169 | nA_0101 | WLTKSGSTY | WLYKSECTY | WL*KS**TY | '001001100' | -1.62 | -1.89 | 1 |
| | | | | | nA_2601 | WLTKSGSTY | WLYKSECTY | WL*KS**TY | '001001100' | -2.13 | -2.34 | 1 |
| | | | | | nA_2902 | WLTKSGSTY | WLYKSECTY | WL*KS**TY | '001001100' | -2.74 | -3.25 | 1 |
| | | | | | nB_5801 | WLTKSGSTY | WLYKSECTY | WL*KS**TY | '001001100' | -1.86 | -2.23 | 1 |
| | | | | 170 | nA_3001 | LTKSGSTYP | LYKSECTYP | L*KS**TYP | '010011000' | -1.3 | -1.91 | 1 |
| | | | | 171 | nB_4002 | TKSGSTYPV | YKSECTYPV | *KS**TYPV | '100110000' | -1.32 | -2.2 | 1 |
| | | | | | nB_4403 | TKSGSTYPV | YKSECTYPV | *KS**TYPV | '100110000' | -1.51 | -2.86 | 1 |
| | | | | 172 | nA_0203 | KSGSTYPVL | KSECTYPVQ | KS**TYPV* | '001100001' | -1.64 | -1.95 | 1 |
| | | | | | nA_2301 | KSGSTYPVL | KSECTYPVQ | KS**TYPV* | '001100001' | -1.24 | -1.33 | 1 |
| | | | | | nA_2402 | KSGSTYPVL | KSECTYPVQ | KS**TYPV* | '001100001' | -1.14 | -1.32 | 1 |
| | | | | 173 | nB_5701 | SGSTYPVLN | SECTYPVQN | S**TYPV*N | '011000010' | -1.01 | -1.2 | 1 |
| | | | | 174 | nA_0101 | GSTYPVLNV | ECTYPVQNV | **TYPV*NV | '110000100' | -1.47 | -2.1 | 1 |
| | Affinity Loss | 1968_HK68 | 1972_EN72 | 166 | nA_0301 | RLNWLTKSG | RLNWLYKSE | RLNWL*KS* | '000001001' | -2.1 | -1.18 | 1 |
| | | | | 167 | nA_3101 | LNWLTKSGS | LNWLYKSEC | LNWL*KS** | '000010011' | -1.66 | -1.61 | 1 |
| | | | | 168 | nA_3301 | NWLTKSGST | NWLYKSECT | NWL*KS**T | '000100110' | -2.03 | -1.82 | 1 |
| | | | | | nB_5301 | NWLTKSGST | NWLYKSECT | NWL*KS**T | '000100110' | -1.82 | -1.35 | 1 |
| | | | | 169 | nA_0201 | WLTKSGSTY | WLYKSECTY | WL*KS**TY | '001001100' | -1.71 | -1.59 | 1 |
| | | | | 172 | nA_0202 | KSGSTYPVL | KSECTYPVQ | KS**TYPV* | '001100001' | -2.02 | -1.76 | 1 |
| | | | | | nB_3501 | KSGSTYPVL | KSECTYPVQ | KS**TYPV* | '001100001' | -1.98 | -1.03 | 1 |
| | | | | 173 | nA_3001 | SGSTYPVLN | SECTYPVQN | S**TYPV*N | '011000010' | -2.04 | -1.81 | 1 |
| | | | | | nB_4002 | SGSTYPVLN | SECTYPVQN | S**TYPV*N | '011000010' | -1.75 | -1.22 | 1 |
| | | | | 174 | nA_6901 | GSTYPVLNV | ECTYPVQNV | **TYPV*NV | '110000100' | -2.36 | -1.5 | 1 |
| | | | | | nB_0801 | GSTYPVLNV | ECTYPVQNV | **TYPV*NV | '110000100' | -1.69 | -1.27 | 1 |
| | | | | | nB_4001 | GSTYPVLNV | ECTYPVQNV | **TYPV*NV | '110000100' | -2.72 | -1.25 | 1 |

FIG. 32

MHC II (Highly Mutable Region) HK68 -> EN72

FIG. 37 gi_2 = IA2, a protein associated with Type 1 diabetes autoimmunity
gi_1 = Rotavirus VP7

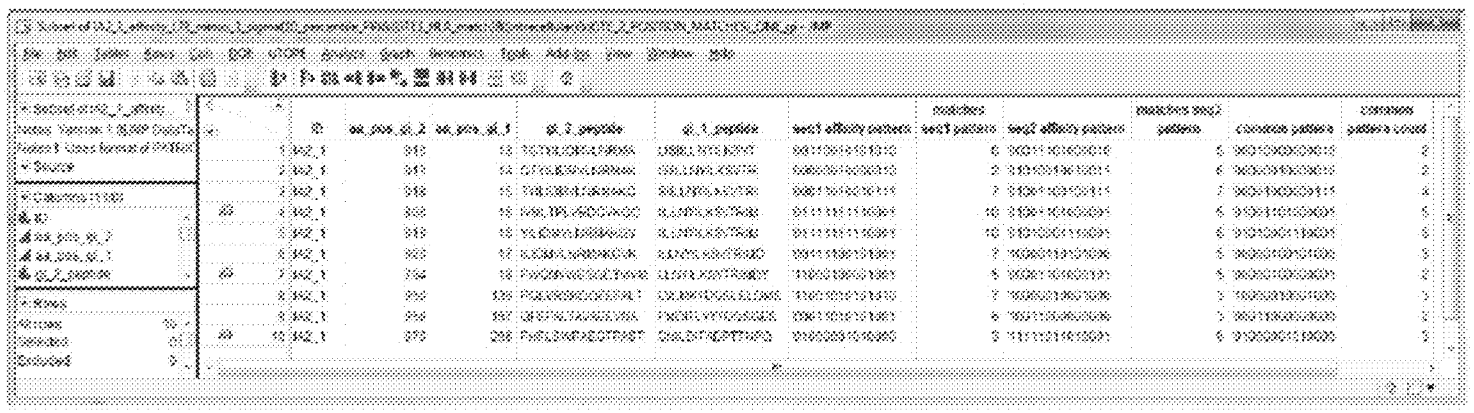

Any peptide pair with <= -1σ binding affinity (all possible combinations of 978 peptides of IA2 and 325 peptides of VP7)

Number in parenthesis = number of peptide pairs at that step

Any peptide pair within the closest 10 Percentile Physical Properties Match (170)

Any IA2 peptide within the Intracellular Domain (as described in experimental process) (56)

Any Peptide pair with high binding affinity to 2 or more HLAs >= 2 HLA & <= -1σ (10)

- Peptides are restricted to a few molecular regions of both proteins
- The peptides of IA2 in rows 4,7 and 10 are used in T1D autoimmune diagnosis and notably are predicted to bind to a large number of MHC II alleles
- Approximately the same number of peptides are found in the extracellular domain but extracellular domains are not associated with autoimmune reactions.

Amino Acid Position

BIOINFORMATIC PROCESSES FOR DETERMINATION OF PEPTIDE BINDING

CROSS-REFERENCE TO RELATED APPLICATIONS

This application is a continuation of U.S. patent application Ser. No. 13/052,733, filed Mar. 21, 2011, allowed as U.S. Pat. No. 10,706,955, which claims the benefit of U.S. Prov. Appl. 61/316,523 filed Mar. 23, 2010, and U.S. Prov. Appl. 61/394,130, filed Oct. 18, 2010, each of which is incorporated by reference herein in their entirety.

REFERENCE TO A SEQUENCE LISTING

The contents of the electronic sequence listing (File Name: 31239-306_ST25.txt; Size: 766,534,000 bytes; Date of Creation: Jul. 13, 2021), submitted on Jul. 13, 2021, on two identical compact discs, is herein incorporated by reference in its entirety.

FIELD OF THE INVENTION

This invention relates to the identification of peptide binding to ligands, and in particular to identification of epitopes expressed by microorganisms and by mammalian cells.

BACKGROUND OF THE INVENTION

Infectious diseases, including some once considered to be controlled by antibiotics and vaccines, continue to be an important cause of mortality worldwide. Currently infectious and parasitic diseases account for over 15% of deaths worldwide and are experiencing a resurgence as a result of increasing antimicrobial drug resistance and as a secondary complication of HIV AIDS. (World Health Organization, Global Burden of Disease 2004). Climate change and increasing population density can also be expected to increase the incidence of infectious diseases as populations encounter new exposure to environmental reservoirs of infectious disease. The 2009 pandemic of H1N1 influenza illustrates the ability of a highly transmissible virus to cause worldwide disease within a few months. The threat of a genetically engineered organism of equal transmissibility is also a grave concern.

Antimicrobial resistance is a growing global problem. Certain species of antibiotic resistant bacteria are contributing disproportionately to increased morbidity, mortality and costs of treatment. Methicillin resistant *Staphylococcus aureus* (MRSA) is a leading cause of nosocomial infections. Factors contributing to the emergence of antimicrobial resistance include broad spectrum antibiotics which place commensal flora, as well as pathogens, under selective pressure. Current broad spectrum antibiotics target a relatively small number of bacterial metabolic pathways. Most of the few recently approved new antimicrobials depend on these same pathways, exacerbating the rapid development of resistance, and vulnerability to bioterrorist microbial engineering (Spellberg et al., Jr. 2004. Clin. Infect. Dis. 38:1279-1286). New strategies for antimicrobial development are urgently needed which move beyond dependence on the same pathways and which enable elimination of specific pathogens without placing selective pressure on the antimicrobial flora more broadly.

In approaching control of infectious diseases by using antibodies or vaccines characterization of antigens or epitopes is needed. Several approaches have been taken to characterization of epitopes. Immunologists have started with the production of monoclonal antibodies or the identification of antibodies in a patient serum bank and, using these, have identified and cloned specific epitopes. This places emphasis on epitopes that are immunodominant, under representing less dominant, but often more conserved, epitopes. Often it has led to characterization of polysaccharide epitopes, more prone to change with growth conditions than gene-coded proteins. The net output is one or two characterized epitopes which may offer protective immunity, but which may be those most likely to induce selective pressure. By definition, this approach focuses entirely on antibody responses. One such example of epitope characterization is described by Burnie et. al. (Burnie et al. 2000. Infect. Immun. 68:3200-3209).

The field of reverse vaccinology adopts the approach of starting with the genome and identifying open reading frames and proteins which are suitable vaccine components and then testing their B-cell immunogenicity (Musser, J. M. 2006. Nat. Biotechnol. 24:157-158; Serruto, D., L. et al. 2009. Vaccine 27:3245-3250). Reverse vaccinology is an extraordinarily powerful approach, with potential to enable rapid identification of proteins with potential epitopes in silico from organisms for which a genome is available, whether or not the organism can be easily cultured in vitro. The first reverse engineered vaccine, to *Neisseria meningitidis* (Pizza et al. 2000. Science 287:1816-1820), is now in Phase 3 clinical trials and has been followed by similar efforts on an array of bacteria (Ariel et a. 2002. Infect. Immun. 70:6817-6827; Betts, J. C. 2002. IUBMB. Life 53:239-242; Chakravarti et al. 2000. Vaccine 19:601-612; Montigiani et al. 2002. Infect. Immun. 70:368-379; Ross et al. 2001. Vaccine 19:4135-4142.; Wizemann et al. 2001. Infect. Immun. 69:1593-1598). Pizza et al, in identifying the antigenic proteins of *N. meningitides* in the proteome, expressed concern that a relatively small proportion of the antigenic proteins they identified could be expressed in *E. coli* because of their hydrophobicity due to transmembrane domains. Rodriguez-Ortega, working with Strep. *pneumoniae*, has used a method of "shaving" the surface loops off proteins with proteases to isolate specific peptides (Rodriguez-Ortega et al. 2006. Nat. Biotechnol. 24:191-197). This approach only harvests those peptide loops which have a minimum of two proteases cuts sites in the loop, resulting in inability to detect about 75% of possible surface peptide epitopes.

Diversity is a feature of all microbial species and most microbial species are represented in nature by many similar but non-identical strains some of which have acquired or lost metabolic traits such as growth characteristics, or antibiotic resistance. In some cases different isolates are antigenically different and do not offer cross protection to a subsequent infection with a different strain. The degree of variability between strains varies from one organism to another. Among the most variable are RNA viruses (e.g., but not limited to foot and mouth disease, influenza virus, rotavirus) which undergo constant mutation and exhibit constant antigenic drift posing a challenge to vaccine selection. Hence among the challenges to epitope mapping is to identify MHC high affinity binding peptides and B-cell epitope sequences which are conserved between multiple strains.

Vaccine development is not limited to those for infectious diseases. In Europe and America, cancer vaccine therapies are being developed, wherein cytotoxic T-lymphocytes inside the body of a cancer patient are activated by the administration of a tumor antigen. Results from clinical studies have been reported for some specific tumor antigens. For example, by subcutaneously administrating melanoma antigen gp100 peptide, and intravascularly administrating interleukin-2 to melanoma patients, reduction of tumors was observed in 42% of the patients. However, when the diversity of cancers is considered, it is impossible to treat all cancers using a cancer vaccine consisting of only one type of tumor antigen. The diversity of cancer cells gives rise to diversity in the type or the amount of tumor antigens being expressed in the cancer cells. These antigens must be identified in order to develop therapies. What is needed are new and more efficient methods of identifying epitopes for use in developing vaccines, diagnostics, and therapeutics.

In some instances disease can arise from an immune reaction directed to the body's own cells, known as autoimmunity. Autoimmunity can arise in a number of situations including, but not limited to a failure in development of tolerance, exposure of an epitope normally shielded from the immune surveillance, or as a secondary effect to exposure to an exogenous antigen which closely resembles or mimics the host cell in MHC or B cell binding characteristics. A growing number of autoimmune diseases are being identified as sequelae to exposure to epitopes in infectious agents which have mimics in the host tissues. Examples include rheumatic fever as a sequel to streptococcal infection, diabetes type 1 linked to exposure to Coxsackie virus or rotavirus and Guillain Barre syndrome associated with prior exposure to *Campylobacter jejueni*.

Beyond the understanding of epitope structure and binding for the purposes of developing vaccines and biotherapeutics there is a broader need to be able to characterize protein interactions in binding reactions, including but not limited to enzymatic reactions, binding of ligands to cell receptors and other physiologic mechanisms.

A mathematical approach to understanding the structurally-based peptide binding mechanisms involved in immunologic and other protein based reactions and which can be implemented in silico would be of great value to the art.

SUMMARY OF THE INVENTION

The present invention is directed to a method for identification in silico of peptides and sets of peptides internal to or on the surface of microorganisms and cells which have a high probability of being effective in stimulating humoral and cell mediated immune responses. The method combines multiple predictive tools to provide a composite of both topology and multiple sets of binding or affinity characteristics of specific peptides within an entire proteome. This allows us to predict and characterize specific peptides which are B-cell epitope sequences and MHC binding regions in their topological distribution and spatial relationship to each other. Further, the present invention identifies the sequences of peptides which have a high probability of being B-cell and/or MHC binding sites comprising T-cell epitopes on the surface of a variety of microorganisms or cells, or MHC binding sites comprising T cell epitopes internal to microorganisms or cells. In some embodiments the binding sites identified are located externally or internally on a virion or are expressed on a virus infected cell.

In some embodiments, the present invention provides processes, preferably computer implemented, for identifying or analyzing ligands comprising: in-putting an amino acid sequence from a target source into a computer; and analyzing more than one physical parameter of subsets of amino acids in the sequence via a computer processor to identify amino acid subsets that interact (e.g., bind) to a binding partner (e.g., a B cell receptor, antibody or MHC-I or MHC-II binding region). In some embodiments, the processes further comprise deriving a mathematical expression to describe the amino acid subsets. In some embodiments, the processes further comprise applying the mathematical expression to predict the ability of the amino acid subsets to bind to a binding partner. In some embodiments, the processes further comprise outputting sequences for the amino acid subsets identified as having an affinity for a binding partner.

In some embodiments, the binding partner is an MHC binding region. In some embodiments, the binding partner is a B-cell receptor or an antibody. In some embodiments, the ligand is a peptide that binds to a MHC binding region. In some embodiments, the MHC binding regions is a MHC-I binding region. In some embodiments, the MHC binding region is a MHC-II binding region. In some embodiments, the ligand is a polypeptide that binds to a B-cell receptor or antibody and to an MHC binding region. In some embodiments, the ligand is a polypeptide that binds to a B-cell receptor or antibody. In some embodiments, the amino acid subset is from about 4 to about 50, about 4 to about 30, about 4 to about 20, about 5 to about 15, or 9 or 15 amino acids in length. In some embodiments, the subsets of amino acid sequences begin at an n-terminus of the amino acid sequence, wherein n is the first amino acid of the sequence and c is the last amino acid in the sequence, and the sets comprise each peptide of from about 4 to about 50 amino acids in length (or the other ranges identified above) starting from n and the next peptide in the set is n+1 until n+1 ends at c for the given length of the peptides selected. In some embodiments, amino acids in the subsets are contiguous.

In some embodiments, the analyzing physical parameters of subsets of amino acids comprises replacing alphabetical coding of individual amino acids in the subset with mathematical expression properties. In some embodiments, the physical parameters properties are represented by one or more principal components. In some embodiments, the physical parameters are represented by at least three principal components or 3, 4, 5, or 6 principal components. In some embodiments, the letter code for each amino acid in the subset is transformed to at least one mathematical expression. In some embodiments, the mathematical expression is derived from principal component analysis of amino acid physical properties. In some embodiments, the letter code for each amino acid in the subset is transformed to a three number representation. In some embodiments, the principal components are weighted and ranked proxies for the physical properties of the amino acids in the subset. In some embodiments, the physical properties are selected from the group consisting of polarity, optimized matching hydrophobicity, hydropathicity, hydropathcity expressed as free energy of transfer to surface in kcal/mole, hydrophobicity scale based on free energy of transfer in kcal/mole, hydrophobicity expressed as Δ G ½ cal, hydrophobicity scale derived from 3D data, hydrophobicity scale represented as π-r, molar fraction of buried residues, proportion of residues 95% buried, free energy of transfer from inside to outside of a globular protein, hydration potential in kcal/mol, membrane buried helix parameter, mean fractional area loss, average area buried on transfer from standard state to folded protein, molar fraction of accessible residues, hydrophilicity, normalized consensus hydrophobicity scale, average surrounding hydrophobicity, hydrophobicity of physiological L-amino acids, hydrophobicity scale represented as $(\pi-r)^2$, retension coefficient in HFBA, retention coefficient in HPLC pH 2.1, hydrophobicity scale derived from HPLC peptide retention times, hydrophobicity indices at pH 7.5 determined by HPLC, retention coefficient in TFA, retention coefficient in HPLC pH 7.4, hydrophobicity indices at pH 3.4 determined by HPLC, mobilities of amino acids on chromatography paper, hydrophobic constants derived from HPLC peptide retention times, and combinations thereof. In some embodiments, the physical properties are predictive of the property of binding affinity for an MHC binding region.

In some embodiments, the processes further comprise constructing a neural network via the computer, wherein the neural network is used to predict the binding affinity to one or more MHC binding region. In some embodiments, the neural network provides a quantitative structure activity relationship. In some embodiments, the first three principal components represent more than 80% of physical properties of an amino acid.

In some embodiments, the processes further comprise constructing a multi-layer perceptron neural network regression process wherein the output is $LN(K_d)$ for a particular peptide binding to a particular MHC binding region. In some embodiments, the regression process produces a series of equations that allow prediction of binding affinity using the physical properties of the subsets of amino acids. In some embodiments, the regression process produces a series of equations that allow prediction of binding affinity using the physical properties of amino acids within the subsets. In some embodiments, the neural network performance with test peptide sets is not statistically different at the 5% level when applied to random peptide sets. In some embodiments, the processes further comprise utilizing a number of hidden nodes in the multi-layer perceptron that correlates to the number of amino acids accommodated by a MHC binding region. In some embodiments, the number of hidden nodes is from about 8 to about 60.

In some embodiments, the neural network is validated with a training set of binding affinities of peptides of known amino acid sequence. In some embodiments, the neural network is trained to predict binding to more than one MHC binding region. In some embodiments, the neural network produces a set of equations that describe and predict the contribution of the physical properties of each amino acids in the subsets to Ln(Ki). In some embodiments, peptide subsets representing at least 25% of the proteome of a target source are analyzed using the equations to provide the $LN(k_d)$ for at least one MHC binding region. In some embodiments, a standardization process is carried out on sets of raw binding affinity data so that characteristics of different MHC molecules can be compared and combined directly even though they have different underlying distributional properties. In the process of standardization the mean of a set of numbers is subtracted from each value in the set and the resulting number divided by the standard deviation. This creates a new set in a transformed variable with a mean of zero and unit variance (and standard deviation as the standard deviation=square root of the variance). These transformed data sets provide a number of desirable properties for statistical analyses.

In some embodiments, the processes further comprise the step of determining the cellular location of the subsets of peptides, wherein the cellular location is selected from the group consisting of intracellular, extracellular, within a membrane, signal peptide, and combinations thereof. In some embodiments, extracellular peptides are selected for further analysis and/or testing.

In some embodiments, the processes further comprise the step of analyzing the subsets of polypeptides for predicted B-cell epitope sequences. In some embodiments, the processes further comprise constructing a neural network via the computer, wherein the neural network is used to predict B-cell epitope sequences. In some embodiments, the processes further comprise the step of correlating the B-cell epitope sequence properties and MHC binding. In some embodiments, the peptides having predicted B-cell epitope sequence properties and MHC binding properties are selected for further analysis and/or testing. In some embodiments, extracellular peptides having predicted B-cell epitope sequence properties and MHC binding properties are selected for further analysis and/or testing. In some embodiments, secreted peptides having predicted B-cell epitope sequence properties and MHC binding properties are selected for further analysis and/or testing. In some embodiments, extracellular peptides conserved across organism strains and having predicted B-cell epitope sequence properties and/or MHC binding properties are selected for further analysis and/or testing. In some embodiments, the MHC binding properties comprise having a predicted affinity for at least one MHC binding region selected from the group consisting of about greater than $10^5$ $M^{-1}$, about greater than $10^6$ $M^{-1}$, about greater than $10^7$ $M^{-1}$, about greater than $10^8$ $M^{-1}$, about greater than $10^9$ $M^{-1}$, and about greater than $10^{10}$ $M^{-1}$. In some embodiments, the processes further comprise selecting peptides having binding affinity to one or more MHC binding regions for further analysis and/or testing. In some embodiments, the process further comprise selecting peptides having binding affinity to at least 2, 4, 10, 20, 30, 40, 50, 60, 70, 80, 90 100 or more MHC binding regions or from 1 to 5, 1 to 10, 1 to 20, 5 to 10, 5 to 20, 10 to 20, 10 to 30 or 10 to 50 for further analysis and/or testing. In some embodiments, the processes further comprise selecting peptides having defined MHC binding properties, wherein the MHC binding properties comprise having a predicted affinity for at least 1, 2, 4, 10, 20, 30, 40, 50, 60, 70, 80, 90 or 100, or from 1 to 5, 1 to 10, 1 to 20, 5 to 10, 5 to 20, 10 to 20, 10 to 30 or 10 to 50 MHC binding regions selected from the group consisting of about greater than $10^5$ $M^{-1}$, about greater than $10^6$ $M^{-1}$, about greater than $10^7$ $M^{-1}$, about greater than $10^8$ $M^{-1}$, about greater than $10^9$ $M^{-1}$, and about greater than $10^{19}$ $M^{-1}$.

In some embodiments, the physical properties are predictive of the property of binding affinity for a B-cell receptor or antibody. In some embodiments, the processes further comprise constructing a neural network via the computer, wherein the neural network is used to predict the binding affinity to one or more B-cell receptors or antibodies. In some embodiments, the processes further comprise the step of selecting peptides having binding affinity to the one or more B-cell receptors or antibodies for further analysis and/or testing. In some embodiments, the physical properties are predictive of the property of binding affinity to a cellular receptor. In some embodiments, the processes further comprise constructing a neural network via the computer, wherein the neural network is used to predict the binding affinity to a cellular receptor. In some embodiments, the processes further comprise the step of selecting peptides having binding affinity to the cellular receptor further analysis and/or testing.

In some embodiments, the amino acid sequence comprises the amino acid sequences of a class of proteins selected from the group consisting of membrane associated proteins in the proteome of a target source, secreted proteins in the proteome of a target organism, intracellular proteins in the proteome of a target source, and viral structural and non-structural proteins. In some embodiments, the process is performed on at least two different strains of a target organism. In some embodiments, the target source is selected from the group consisting of prokaryotic and eukaryotic organisms. In some embodiments, the target source is selected from the group consisting of bacteria, archaea, protozoas, viruses, fungi, helminthes, nematodes, and mammalian cells. In some embodiments, the mammalian cells are selected from the group consisting of neoplastic cells, carcinomas, tumor cells, cancer cells, and cells bearing an epitope which elicits an autoimmune reaction. In some embodiments, the target source is selected from the group consisting of an allergen, an arthropod, a venom and a toxin. In some embodiments, the target source is selected from the group consisting of *Staphylococcus aureus, Staphylococcus epidermidis, Cryptosporidium parvum* and *Cryptosporidium hominis, Mycobacterium tuberculosis, Mycobacterium avium, Mycobacterium ulcerans, Mycobacterium abcessus, Mycobacterium leprae, Giardia intestinalis, Entamoeba histolytica, Plasmodium* spp, influenza A virus, HTLV-1, Vaccinia and Rotavirus. In some embodiments, the target source is an organism identified in Tables 14A or 14B.

In some embodiments, at least 80% of possible amino acid subsets within the amino acid sequence of length n are analyzed, where n is from about 4 to about 60. In some embodiments, the amino acid subset is conserved across multiple strains of a given organism. In some embodiments, multiple strains are selected from the group consisting of 3 or more, 5 or more, 10 or more, 20 or more, 30 or more, 40 or and 60 or more, and 100 or more strains.

In some embodiments, the processes further comprise the step of synthesizing an amino acid subset identified in the foregoing processes to provide a synthetic polypeptide. In some embodiments, the processes further comprise synthesizing a nucleic acid encoding an amino acid subset identified the foregoing processes. In some embodiments, the processes further comprise testing an amino acid subset identified in claim 1. In some embodiments, the processes further comprise formulating a vaccine with one or more amino acid subset identified claim 1. In some embodiments, the processes further comprise testing the vaccine in a human or animal model. In some embodiments, the processes further comprise administering the vaccine to a human or an animal. In some embodiments, the processes further comprise producing an antibody or fragment thereof which binds to the amino acid subset identified in claim 1. In some embodiments, the processes further comprise testing the antibody or fragment thereof in a human or animal model. In some embodiments, the processes further comprise testing the antibody or fragment thereof in a diagnostic assay. In some embodiments, the processes further comprise performing a diagnostic assay with the antibody or fragment thereof. In some embodiments, the processes further comprise administering the antibody or fragment thereof to a human or animal. In some embodiments, the processes further comprise the step of synthesizing a fusion protein comprising an accessory polypeptide operably linked to the antibody or fragment thereof. In some embodiments, the accessory polypeptide selected from the group consisting of an enzyme, an antimicrobial polypeptide, a cytokine and a fluorescent polypeptide. In some embodiments, the process is performed on proteins of the group consisting of desmoglein 1, 3, and 4, collagen, annexin, envoplakin, bullous pemphigoid antigen BP180, collagen XVII, bullous pemphigoid antigen BP230, laminin, ubiquitin, Castelman's disease immunoglobulin, integrin, desmoplakin, and plakin.

In some embodiments, the processes further comprise selecting a polypeptide comprising the amino acid subset identified as having an affinity for a binding partner; immunizing a host and monitoring the development of an immune response; harvesting the antibody producing cells of the host and preparing hybridomas secreting antibodies which bind to the selected peptide; cloning at least the variable region of the antibody to provide a nucleic acid sequence encoding a recombinant antigen binding protein; and expressing the nucleic acid sequence encoding a recombinant antigen binding protein in a host cell. In some embodiments, the processes further comprise isolating the recombinant antigen binding protein encoded by the nucleic acid. In some embodiments, the antibody is directed to an epitope from a group comprising a microbial epitope, a cancer cell epitope, an autoimmune epitope, and an allergen. In some embodiments, the processes further comprise performing a diagnostic or therapeutic procedure with the recombinant antigen binding protein. In some embodiments, the processes further comprise engineering the recombinant antigen binding protein to form a fusion product wherein the antibody is operatively linked to an accessory molecule selected from the group comprising an antimicrobial peptide, a cytotoxin, and a diagnostic marker.

In some embodiments, the processes further comprise selecting a polypeptide comprising the amino acid subset identified as having an affinity for a binding partner; and immunizing a host with the polypeptide in a pharmaceutically acceptable carrier. In some embodiments, the target source is selected from the group consisting of a microorganism and a mammalian cell. In some embodiments, the amino acid subset is conserved in a plurality of isolates of the microorganism selected from the group consisting of 3 or more, 5 or more, 10 or more, 20 or more, 30 or more, 40 or and 60 or more, and 100 or more isolates. In some embodiments, the processes further comprise the amino acid subset is conserved in 1 or more tumor cell isoforms. In some embodiments, the polypeptide is fused to an immunoglobulin Fc portion. In some embodiments, the polypeptide is presented in a manner selected from the group consisting of arrayed on a lipophilic vesicle, displayed on a host cell membrane, and arrayed in a virus like particle. In some embodiments, the polypeptide is expressed in a host cell. In some embodiments, the polypeptide is chemically synthesized. In some embodiments, the target source is selected from the group consisting of a bacteria, a virus, a parasite, a fungus a *rickettsia*, a *mycoplasma*, and an archaea. In some embodiments, the polypeptide is a tumor associated antigen. In some embodiments, the vaccine is a therapeutic vaccine. In some embodiments, the vaccine is delivered by a delivery method selected from the group consisting of oral, intranasal, inhalation and parenteral delivery. In some embodiments, the polypeptide is immunogenic for subjects whose HLA alleles are drawn from a group comprising 10 or more different HLA alleles. In some embodiments, the polypeptide is immunogenic for subjects whose HLA alleles are drawn from a group comprising 20 or more different HLA alleles. In some embodiments, the polypeptide is selected to be immunogenic for the HLA allelic composition of an individual patient. In some embodiments, the vaccine for an individual patient is a therapeutic vaccine.

In some embodiments, the processes further comprise identifying amino acid subsets that are present in a vaccine to a target selected from the group consisting of a microorganism and a mammalian target protein; comparing epitopes in the vaccine to the amino acid subsets in one or more isolates or isoforms of the target; and determining the presence of the amino acid subset in the one or more isolates or isoforms. In some embodiments, the microorganism is from the group consisting of a bacteria, a virus, a parasite, a fungus, a *Rickettsia*, a *mycoplasma*, and an archaea. In some embodiments, the mammalian target protein is a tumor associated antigen. In some embodiments, the vaccine is a therapeutic vaccine. In some embodiments, the vaccine is delivered by a delivery method selected from the group consisting of oral, intranasal, inhalation and parenteral delivery.

In some embodiments, the processes further comprise selecting a polypeptide comprising the amino acid subset identified as having an affinity for a binding partner; displaying the polypeptide so that antibody binding to it can be detected; contacting the peptide with antisera from a subject suspected of being exposed to the microorganism from which the polypeptide is derived; and determining if antibody binds to the polypeptide.

In some embodiments, the processes further comprise selecting a polypeptide comprising the amino acid subset identified as having an affinity for a binding partner; preparing an antibody specific to the polypeptide; applying the antibody or a recombinant derivate thereof to determine the presence of the microorganism from which the peptide is derived. In some embodiments, the peptide is present in the wild type isolate of the microorganism but is not present in a vaccine strain or a vaccine protein, allowing the diagnostic test to differentiate between vaccines and infected individuals.

In some embodiments, the processes further comprise selecting a polypeptide comprising the amino acid subset identified as having an affinity for a binding partner, wherein the target source is a new isolate of a microorganism; comparing the peptide from the new isolate of the microorganism with a peptide similarly identified in a reference sequence of the microorganism; and determining differences between the reference and new strains of the microorganism as determined by antibody binding, MHC binding or predicted binding.

In some embodiments, the processes further comprise selecting a polypeptide comprising the amino acid subset identified as having an affinity for a binding partner, wherein the target sequence is a protein that is linked to an autoimmune response; preparing a recombinant fusion of the peptide linked to a cytotoxic molecule; and contacting a subject with the peptide fusion wherein immune cells targeting the autoimmune target bind to the peptide and are destroyed by the cytotoxin. In some embodiments, the immune cells are B cells. In some embodiments, the immune cells are T cells which bind the peptide in conjunction with an MHC molecule.

In some embodiments, the processes further comprise providing a biotherapeutic protein as the target source; and identifying amino acid subsets within the biotherapeutic protein which are immunogenic. In some embodiments, the processes further comprise producing a variant of the biotherapeutic protein wherein the biotherapeutic protein retains a desired therapeutic activity and exhibits reduced immunogenicity as compared to the target source. In some embodiments, the processes further comprise providing a biotherapeutic protein as the target source; identifying polypeptides comprising amino acid subsets within the biotherapeutic peptide which are highly immunogenic; and constructing fusions of the polypeptides with cytotoxins; administering the fusions to a host which has developed an immune reaction to the biotherapeutic under conditions that B cells reactive with the polypeptide are reduced.

In some embodiments, the processes further comprise identifying a combination of amino acid subsets and MHC binding partners which predispose a subject to a disease outcome. In some embodiments, the processes further comprise screening a population to identify individuals with a HLA haplotype which predisposes individuals with the HLA haplotype to a disease outcome. In some embodiments, the processes further comprising applying the information to design a clinical trial in which patients represent multiple HLA alleles with different binding affinity to said amino acid subset. In some embodiments, the processes further comprise excluding the subjects from a clinical trial.

In some embodiments, present invention provides a nucleic acid encoding a polypeptide comprising the amino acid subset identified as described above. In some embodiments, the present invention provides a nucleic acid that hybridizes to the nucleic acid described above. In some embodiments, the present invention provides vectors comprising the nucleic acid described above. In some embodiments, the present invention provides cells comprising the nucleic acid described above, wherein aid nucleic acid is exogenous to the cell.

In some embodiments, the present invention provides an antibody or fragment thereof that binds to a polypeptide comprising the amino acid subset identified as described above. In some embodiments, the antibody or fragment is fused to an accessory polypeptide. In some embodiments, the accessory polypeptide is an antimicrobial polypeptide.

In some embodiments, the present invention provides a vaccine comprising a polypeptide comprising the amino acid subset identified in as described above. In some embodiments, the present invention provides a vaccine comprising more than one polypeptide comprising the amino acid subset identified as described above. In some embodiments, the present invention provides a vaccine comprising more than five polypeptides comprising the amino acid subset identified as described above. In some embodiments, the present invention provides a vaccine comprising from 1 to about 20 polypeptides comprising the amino acid subset identified as described above.

In some embodiments, the present invention provides a composition comprising the polypeptide comprising the amino acid subset identified as described above and an adjuvant. In some embodiments, the present invention provides a composition comprising a plurality of polypeptides identified as described above.

In some embodiments, the present invention provides a synthetic polypeptide (e.g., a recombinant polypeptide or chemically synthesized polypeptide) comprising a peptide sequence that binds to at least one major histocompatibility complex (MHC) binding region with a predicted affinity of greater than about $10^6$ M$^{-1}$ and/or to a B-cell epitope sequence wherein the MHC binding region and the B cell epitope sequence overlap or have borders within about 3 to about 20 amino acids. In some embodiments, the sequences are from native proteins selected from the group consisting of a transmembrane protein having a transmembrane portion, secreted proteins, proteins comprising a membrane motif, viral structural proteins and viral non-structural proteins. In some embodiments, the native protein is a transmembrane protein having a transmembrane portion, wherein the peptide sequences are internal or external to the transmembrane portion of the native transmembrane protein. In some embodiments, the native protein is a secreted protein. In some embodiments, the native protein is protein comprising a membrane motif. In some embodiments, the sequences are from intracellular native proteins. In some embodiments, the intracellular protein is selected from the group consisting of nuclear proteins, mitochondrial proteins and cytoplasmic proteins. In some embodiments, the synthetic polypeptide is from about 10 to about 150 amino acids in length. In some embodiments, the B-cell epitope sequence is external to the transmembrane portion of the transmembrane protein and wherein from about 1 to about 20 amino acids separate the B-cell epitope sequence from the transmembrane portion. In some embodiments, the B-cell epitope sequence is located in an external loop portion or N-terminal or C-terminal tail portion of the transmembrane protein. In some embodiments, the external loop portion or tail portion comprises less than two consensus protease cleavage sites. In some embodiments, the external loop portion or tail portion comprises more than one B-cell epitope sequence. In some embodiments, the polypeptide comprises more than one B-cell epitope sequence. In some embodiments, the B-cell epitope sequence comprises one or more hydrophilic amino acids. In some embodiments, the MHC binding region is a MHC-I binding region. In some embodiments, the MHC binding region is a MHC-II binding region. In some embodiments, amino acids encoding the B-cell epitope sequence overlap with the peptide sequence that binds to a MHC.

In some embodiments, the synthetic polypeptide comprise more than one peptide that binds to a MHC, wherein the peptides that binds to each MHC are from different loop or tail portions of one or more transmembrane proteins. In some embodiments, the peptide sequence that binds to a MHC binding region and/or the B-cell epitope sequence are located partially in a cell membrane spanning-region and partially in an external loop or tail region of the transmembrane protein. In some embodiments, the peptide that binds to a MHC binding region is from about 4 to about 20 amino acids in length. In some embodiments, the MHC binding region is a human MHC binding region. In some embodiments, the MHC binding region is a mouse MHC binding region. In some embodiments, the peptide sequence that binds to a MHC binding region and the B-cell epitope sequence are conserved across two or more strains of a particular organism. In some embodiments, the peptide sequence that binds to a MHC binding region and the B-cell epitope sequence are conserved across ten or more strains of a particular organism.

In some embodiments, the synthetic polypeptide comprises a peptide that binds to a MHC binding region with an affinity selected from the group consisting of about greater than $10^6$ $M^{-1}$, about greater than $10^7$ $M^{-1}$, about greater than $10^8 M^{-1}$, and about greater than $10^9 M^{-1}$. In some embodiments, the peptide has a high affinity for from one to about ten MHC binding regions. In some embodiments, the peptide has a high affinity for from about 10 to about 100 MHC binding regions.

In some embodiments, the polypeptide is from an organism selected from the group consisting of *Staphylococcus aureus, Staphylococcus epidermidis, Cryptosporidium parvum* and *Cryptosporidium hominis, Mycobacterium tuberculosis, Mycobacterium avium, Mycobacterium ulcerans, Mycobacterium abcessus, Mycobacterium leprae Giardia intestinalis, Entamoeba histolytica*, and *Plasmodium* spp. In some embodiments, the polypeptide is from an organism identified in Table 14A or 14B. In some embodiments, the peptide sequence that binds to a MHC binding region and the B-cell epitope sequence is conserved in two or more strains of an organism. In some embodiments, the organism is *Staphylococcus aureus* and the peptide sequence that binds to a major histocompatibility complex (MHC) and the B-cell epitope sequence is conserved in 10, 20, 30, 40, 50, 60 or more strains of *Staphylococcus aureus*. In some embodiments, the organism is *Mycobacterium tuberculosis* and the peptide sequence that binds to a MHC and the B-cell epitope is conserved in 3, 5, 10, 20, 30 or more strains of *Mycobacterium tuberculosis*. In some embodiments, the polypeptide is native to a source selected from the group consisting of prokaryotic and eukaryotic organisms. In some embodiments, the polypeptide is native to a source selected from the group consisting of bacteria, archaea, protozoa, viruses, fungi, helminthes, nematodes, and mammalian cells. In some embodiments, the mammalian cells are selected from the group consisting of neoplastic cells, carcinomas, tumor cells, and cancer cells. In some embodiments, the polypeptide is native to a source selected from the group consisting of an allergen, parasite salivary components, an arthropod, a venom and a toxin. In some embodiments, the polypeptide is from human protein selected from the group consisting of desmoglein 1, 3, and 4, collagen, annexin, envoplakin, bullous pemphigoid antigen BP180, collagen XVII, bullous pemphigoid antigen BP230, laminin, ubiquitin, Castelman's disease immunoglobulin, integrin, desmoplakin, and plakin. In some embodiments, the polypeptide comprises at least one of SEQ ID NOs. 00001-3407292. In some embodiments, the present invention provides a polypeptide sequence or vaccine which comprises a polypeptide encoded by SEQ ID NO: 00001-3407292. In some embodiments, the present invention provides an antigen binding protein that binds to a polypeptide encoded by SEQ ID NO: 00001-3407292. In some embodiments, the present invention provides a nucleic acid encoding a polypeptide as described above. In some embodiments, the present invention provides a vector comprising the foregoing nucleic acid. In some embodiments, the present invention provides a cell comprising the foregoing nucleic, wherein the nucleic acid is exogenous to the cell.

In some embodiments, the present invention provides an antibody or fragment thereof that binds to the B-cell epitope sequence encoded by the foregoing polypeptides. In some embodiments, the present invention provides an antibody or fragment thereof that binds to the peptide sequence, wherein the peptide binds to at least one major histocompatibility complex (MHC) binding region as described above. In some embodiments, the antibody or fragment is fused to an accessory polypeptide. In some embodiments, the accessory polypeptide is selected from the group consisting of an enzyme, an antimicrobial polypeptide, a cytokine, and a fluorescent polypeptide.

In some embodiments, the present invention provides a vaccine comprising a synthetic polypeptide as described above. In some embodiments, the present invention provides a composition comprising a synthetic polypeptide as described above and an adjuvant. In some embodiments, the present invention provides a composition comprising a synthetic polypeptide as described above and a carrier protein.

In some embodiments, the present invention provides a computer system or computer readable medium comprising a neural network that determines binding affinity of a polypeptide to one or more MHC alleles by using one or more principal components of amino acids as the input layer of a multilayer perceptron neural network. In some embodiments, the neural network has a plurality of nodes. In some embodiments, the neural network has 9 or 15 nodes.

In some embodiments, the present invention provides a computer system or computer readable medium comprising a neural network that determines binding of a peptide to at least one MHC binding region. In some embodiments, the neural network determines binding of a peptide to at least ten MHC binding regions. In some embodiments, the neural network determines the permuted average binding of a peptide to at least ten MHC binding regions. In some embodiments, the neural network determines the permuted average binding of a peptide to at least 100 MHC binding regions. In some embodiments, the neural network determines the permuted average binding of a peptide to all haplotype combinations. In some embodiments, the neural network determines the permuted average binding of a peptide to all haplotype combinations for which training sets are available.

In some embodiments, the present provide a computer system configured to provide an output comprising a graphical representation of the properties of a polypeptide, wherein the amino acid sequence forms one axis, and topology, MHC binding regions and affinities, and B-cell epitope sequences are charted against the amino acid sequence axis.

In some embodiments, the present invention provides methods for production of antibodies to a single polypeptide comprising: selecting a microbial peptide and stably expressing the polypeptide in a heterologous cell line; immunizing an animal with a preparation of cells heterologously expressing the polypeptide of interest; and harvesting antibody and or lymphocytes from the immunized animal. In some embodiments, the polypeptide is a microbial polypeptide. In some embodiments, the polypeptide is a polypeptide as described above. In some embodiments, the antibody is harvested from the blood of the immunized animal. In some embodiments, the animal is selected from the group consisting of a mouse, rat, goat, sheep, guinea pig, and chicken. In some embodiments, the heterologous cell line is a continuous line. In some embodiments, the continuous line is a BalbC 3T3 line. In some embodiments, the cell line is a primary cell line. In some embodiments, the protein is expressed on the outer surface of the membrane of the heterologously expressing cell line. In some embodiments, the stable expression is achieved by transduction with a retrovector encoding the polypeptide of interest. In some embodiments, the cells of the immunized animal are harvested for production of a hybridoma line. In some embodiments, the present invention provides a hybridoma line expressing antibodies binding to a polypeptide as described above. In some embodiments, the present invention provides a continuous cell line expressing a recombinant version of the antibodies binding to the polypeptide as described above.

In some embodiments, the present invention provides computer implemented process of identifying epitope mimics comprising: providing amino acid sequences from at least first and second polypeptide sequences; applying principal components analysis to amino acid subsets from the at least first and second polypeptide sequences; and identifying epitope mimics within the at least first and second polypeptide sequences based on the predicted binding the amino acid subsets, wherein amino acid subsets with similar predicted binding characteristics are identified as epitope mimics. In some embodiments, the predicted binding characteristics are MHC binding affinity selected from the group consisting of about greater than $10^6$ $M^{-1}$, about greater than $10^7$ $M^{-1}$, about greater than $10^8$ $M^{-1}$, and about greater than $10^9$ $M^{-1}$. In some embodiments, the predicted binding characteristics are B cell receptor or antibody binding affinity. In some embodiments, the processes further comprise assessing chemical structure similarity of the at least first and second polypeptide sequences. In some embodiments, the principal components analysis comprises: representing an amino acid subset by a vector comprising the physical properties of each amino acid; creating a matrix by multiplication of the vectors of two amino acid subsets; utilizing the diagonal elements in the matrix as a measure of the Euclidian distance of physical properties between the two amino acid subsets; weighting the diagonal by the variable importance projection of amino acid positions in a MHC molecule; and identifying amino acid subset pairs with a low distance score for physical properties and a high binding affinity for one or more MHC molecules. In some embodiments, the physical parameters properties are represented by one or more principal components. In some embodiments, the physical parameters are represented by at least three principal components. In some embodiments, the letter code for each amino acid in the subset is transformed to at least one mathematical expression. In some embodiments, the mathematical expression is derived from principal component analysis of amino acid physical properties. In some embodiments, the letter code for each amino acid in the subset is transformed to a three number representation. In some embodiments, the principal components are weighted and ranked proxies for the physical properties of the amino acids in the subset. In some embodiments, the physical properties are selected from the group consisting of polarity, optimized matching hydrophobicity, hydropathicity, hydropathcity expressed as free energy of transfer to surface in kcal/mole, hydrophobicity scale based on free energy of transfer in kcal/mole, hydrophobicity expressed as Δ G ½ cal, hydrophobicity scale derived from 3D data, hydrophobicity scale represented as π–r, molar fraction of buried residues, proportion of residues 95% buried, free energy of transfer from inside to outside of a globular protein, hydration potential in kcal/mol, membrane buried helix parameter, mean fractional area loss, average area buried on transfer from standard state to folded protein, molar fraction of accessible residues, hydrophilicity, normalized consensus hydrophobicity scale, average surrounding hydrophobicity, hydrophobicity of physiological L-amino acids, hydrophobicity scale represented as (π–r)2, retension coefficient in HFBA, retention coefficient in HPLC pH 2.1, hydrophobicity scale derived from HPLC peptide retention times, hydrophobicity indices at pH 7.5 determined by HPLC, retention coefficient in TFA, retention coefficient in HPLC pH 7.4, hydrophobicity indices at pH 3.4 determined by HPLC, mobilities of amino acids on chromatography paper, hydrophobic constants derived from HPLC peptide retention times, and combinations thereof.

In some embodiments, the amino acid subsets are 15 amino acids in length. In some embodiments, the amino acid subsets are 9 amino acids in length. In some embodiments, the MHC binding region is a MHC-1 binding region. In some embodiments, the MHC binding region is a MHC-II binding region. In some embodiments, all sequential amino acid subsets differing by one or more amino acids in the at least first and second polypeptide sequences are input. In some embodiments, the output is used to predict the epitope similarity between two amino acid subsets comprising differing amino acid sequences. In some embodiments, a polypeptide sequence comprising one amino acid subset elicits an immune reaction in a host and the resulting immune reaction is directed to the other amino acid subset. In some embodiments, the at least first and second polypeptide sequences are from different organisms. In some embodiments, the one organism is a microorganism and the other is a mammal. In some embodiments, one of the at least first and second polypeptide sequences from the organism is the target of an adverse immune response. In some embodiments, the immune response is a B cell response. In some embodiments, the immune response is a T cell response. In some embodiments, one of the at least first and second polypeptide sequences is a polypeptide sequence that is used in vaccine or a candidate for use in a vaccine and the process is applied to develop a vaccine that is substantially free of epitope mimics. In some embodiments, one of the at least first and second polypeptide sequences is a polypeptide sequence that is a biotherapeutic protein or a candidate for use in as a biotherapeutic protein and the process is applied to develop a biotherapeutic protein that is substantially free of epitope mimics. In some embodiments, the present invention provides a vaccine developed as described above. In some embodiments, the present invention provides the biotherapeutic protein as described above.

In some embodiments, the present invention for the use of a peptide, polypeptide, nucleic acid, antibody or fragment thereof, or vaccine for use for administration to a subject in need of treatment, for example for prevention of a disease or therapy for a disease. In some embodiments, the present invention peptides or polypeptides as described above for use in formulating a vaccine for administration to animal or human. In some embodiments, the present invention peptides or polypeptides as described above for use producing antibodies or fragments thereof to the peptide or polypeptide. In some embodiments, the present invention provides the antibodies or fragments thereof as described above for use in a diagnostic assay.

DESCRIPTION OF THE FIGURES

The patent or application file contains at least one drawing executed in color. Copies of this patent or patent application publication with color drawings will be provided by the Office upon request and payment of the necessary fee.

FIG. 2 provides principal components on the correlations of various physicochemical properties of amino acids from 31 different studies.

FIG. 14. Overlay of different metrics showing predicted epitope locations and cellular topologies for *Staphylococcal* enterotoxin B (SA00266-0 NC_002951.57651597). Colored bars represent areas of predicted B-cell epitope sequences (orange), MHC-II (blue), coincident MHC-II and B-cell epitope sequences (green) as indicated in the legend inset.

The lines with triangular ends are regions of the protein with experimentally mapped B-cell epitope sequences (red, below predictions) and CD4 T-cell stimulatory regions indicative sources of peptides bound to the MHC-II (green, above predictions). The background semi-transparent colored shading indicate the different protein topologies for signal peptide (white), extracellular (yellow), transmembrane (green) and intracellular (fuchsia).

Figure 15:
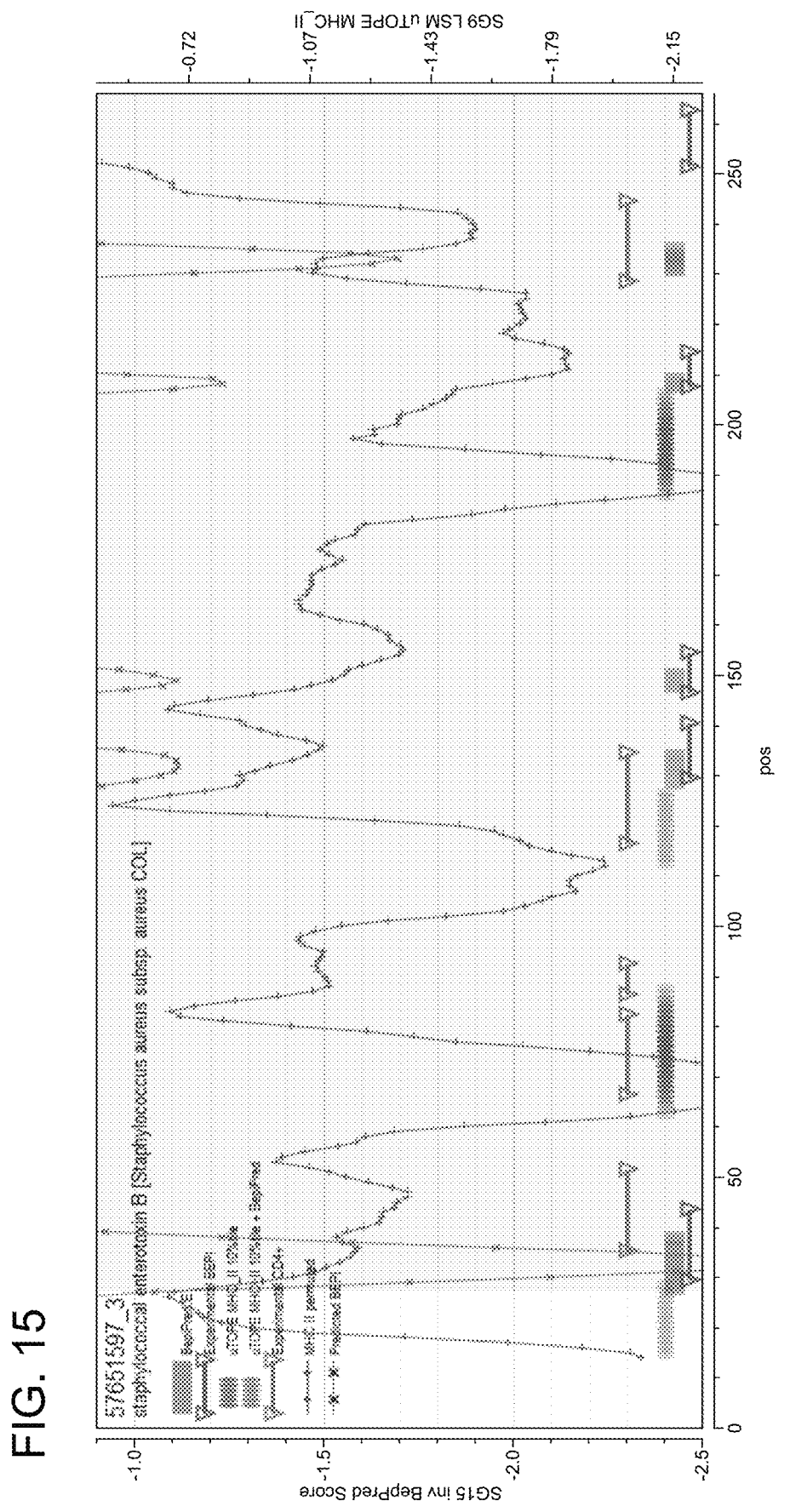

FIG. 15. Overlay of different metrics showing predicted epitope locations and cellular topologies for *Staphylococcal* enterotoxin A (SA00239-1 NC_002952.49484070). Colored bars represent areas of predicted B-cell epitope sequences (orange), MHC-II (blue), coincident MHC-II and B-cell epitope sequences (green) as indicated in the legend inset. The lines with triangular ends are regions of the protein with experimentally mapped B-cell epitope sequences (red, below predictions) and CD4 T-cell stimulatory regions indicative sources of peptides bound to the MHC-II (green, above predictions). The background semi-transparent colored shading indicate the different protein topologies for signal peptide (white), extracellular (yellow), transmembrane (green) and intracellular (fuchsia).

FIG. 16A. Overlay of different metrics showing predicted epitope locations and cellular topologies for *Staphylococcus aureus* Iron Regulated Determinant B (SA00645 NC_002951.57651738). Colored bars represent areas of predicted B-cell epitopes (orange), MHC-II (blue), coincident MHC-II and B-cell epitopes (green) as indicated in the legend inset. The narrow red bars are regions of the protein with experimentally mapped B-cell epitopes (red, above predictions). The background semi-transparent colored shading indicate the different protein topologies for signal peptide (white), extracellular (yellow), transmembrane (green) and intracellular (fuchsia). In this graphic the black line shows the average minimum for a window of 9 amino acids for permuted 14 HLA alleles and the average permuted minimum over the entire proteome as the median horizontal red line.

FIG. 16B. This graphic shows the same protein as FIG. 16*a, Staphylococcus aureus* Iron Regulated Determinant B. In this figure the average minimum for a window of 9 amino acids permuted 14 HLA alleles is again shown as the black line. Superimposed as the green line is the minimum binding affinity for each 9 amino acid segment for one HLA allele, DRB1-0301. FIG. 16*c*. This graphic shows the same protein as FIG. 16*a, Staphylococcus aureus* Iron Regulated Determinant B. In this figure the average minimum for a window of 9 amino acids permuted 14 HLA alleles is again shown as the black line. Superimposed as the green line is the minimum binding affinity for each 9 amino acid segment for one HLA allele, DRB1_0401.

FIG. 17. Overlay of different metrics showing predicted epitope locations and cellular topologies for *Staphylococcus aureus* cell wall surface anchor protein IsdB (SA00533 NC_002951.5765.1892). Colored bars represent areas of predicted B-cell epitope sequences (orange), MHC-II (blue), coincident MHC-II and B-cell epitopes (green) as indicated in the legend inset. The lines with triangular ends are regions of the protein with experimentally mapped B-cell epitopes (red, below predictions) and CD4 T-cell stimulatory regions indicative sources of peptides bound to the MHC-II (green, above predictions). The background semi-transparent colored shading indicate the different protein topologies for signal peptide (white), extracellular (yellow), transmembrane (green) and intracellular (fuchsia).

FIGS. 18A and 18B and FIG. 19 provide matrices showing binding affinity of HLA classes to 15mers comprised within peptides sp378 and sp400 of HTLV-1. HLA classes of interest DRB1_0101 and DRB1_0405 are shaded; these alleles were associated with myelopathy/tropical spastic paraparesis (HAM/TSP) (see Kitze et al 1998). Cells with dark borders are those 15-mers with predicted binding affinities <=50 nM.

FIG. 20. Overlay of different metrics showing predicted epitope locations and cellular topologies for HTLV-1 gp46. Colored bars represent areas of predicted B-cell epitopes (orange), MHC-II (blue), coincident MHC-II and B-cell epitopes (green) as indicated in the legend inset. The lines with triangular ends are regions of the protein with experimentally mapped B-cell epitopes (red, below predictions) and CD4 T-cell stimulatory regions indicative sources of peptides bound to the MHC-II (green, above predictions). The background semi-transparent colored shading indicate the different protein topologies for signal peptide (white), extracellular (yellow), transmembrane (green) and intracellular (fuchsia).

FIG. 21. Overlay of different metrics showing predicted epitope locations and cellular topologies for *Streptococcus pyogenes* M protein. Colored bars represent areas of predicted B-cell epitopes (orange), MHC-II (blue), coincident MHC-II and B-cell epitopes (green) as indicated in the legend inset. The lines with triangular ends are regions of the protein with experimentally mapped B-cell epitopes (red, below predictions) and CD4 T-cell stimulatory regions indicative sources of peptides bound to the MHC-II (green, above predictions). The background semi-transparent colored shading indicate the different protein topologies for signal peptide (white), extracellular (yellow), transmembrane (green) and intracellular (fuchsia).

FIG. 22. Overlay of different metrics showing predicted epitope locations and cellular topologies for *Mycobacterium tuberculosis* protein 8.4. Colored bars represent areas of predicted B-cell epitopes (orange), MHC-II (blue), coincident MHC-II and B-cell epitopes (green), MHC-I (purple) and coincident MHC-I and B-cell epitopes (grey) as indicated in the legend inset. The lines with triangular ends are regions of the protein with experimentally mapped T-cell epitopes (green, above predictions).

FIG. 23. Overlay of different metrics showing predicted epitope locations and cellular topologies for *Mycobacterium tuberculosis* protein 85B. Colored bars represent areas of predicted B-cell epitopes (orange), MHC-II (blue), coincident MHC-II and B-cell epitopes (green), MHC-I (purple) and coincident MHC-I and B-cell epitopes (grey) as indicated in the legend inset. The lines with triangular ends are regions of the protein with experimentally mapped T-cell epitopes (green, above predictions).

FIG. 24. Comparisons of different prediction schemes for prediction of MHC-II binding affinity. Comparison of the performance of 3 different NN predictors and PLS with the IEDB training set and a random set of 15-mer peptides drawn from the proteome of *Staphylococcus aureus* COL. The mean estimate of the NN described as Method 2 in the text is used as the base comparator. Comparisons are based on the Pearson correlation coefficient (r) of the predicted ln(ic50) as a metric. The error bar is the standard deviation of the r obtained for the 14 different MHC-II alleles.

FIG. 25 shows that the computer prediction identifies an overlap of B cell epitope sequences, MHC-I and MHC-II high affinity binding from amino acids 200-230 and an overlap of a B cell epitope and a MHC-I from amino acids 50-70.

FIGS. 26A and 26B show BP180 and demonstrate that the computer prediction system predicts a high affinity MHC-II regions from 505-522, a high affinity MHC-I binding region from 488-514 and from 521-529, regions which overlap with a predicted B cell epitope from 517-534 forming a coincident epitope group from 507-534.

Figure 27:
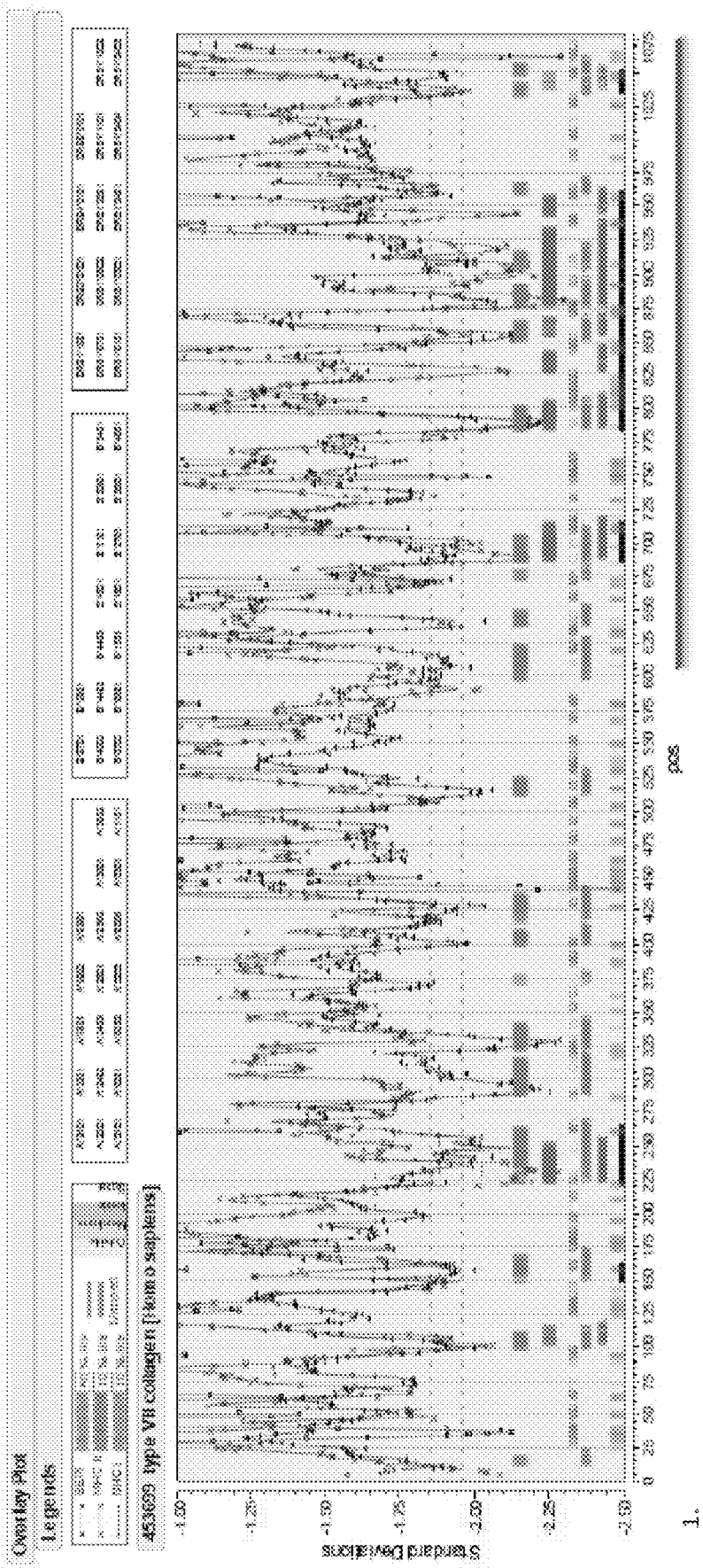

FIG. 27 shows collagen VII and demonstrate that the computer prediction system predicts seven discrete MHC-II high affinity binding regions within a 600 a.a. stretch of collagen VII.

Figure 28:
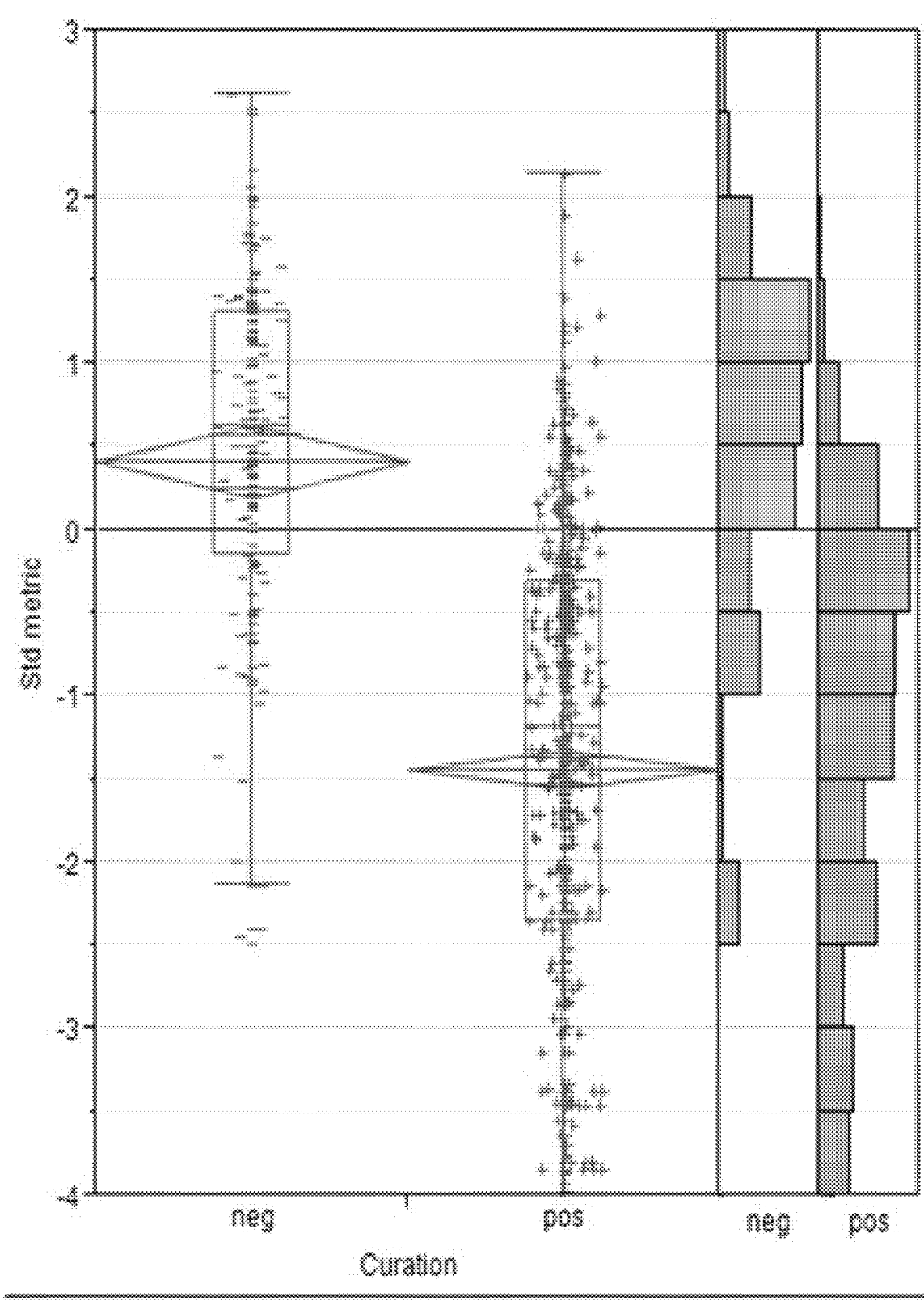

FIG. 28 shows the relationship between the subset of experimentally defined HA epitopes from IEDB and the standardized predicted affinity using the methods described herein. The differences shown are highly statistically significant (the diamonds are the confidence interval about the mean).

Figure 29:
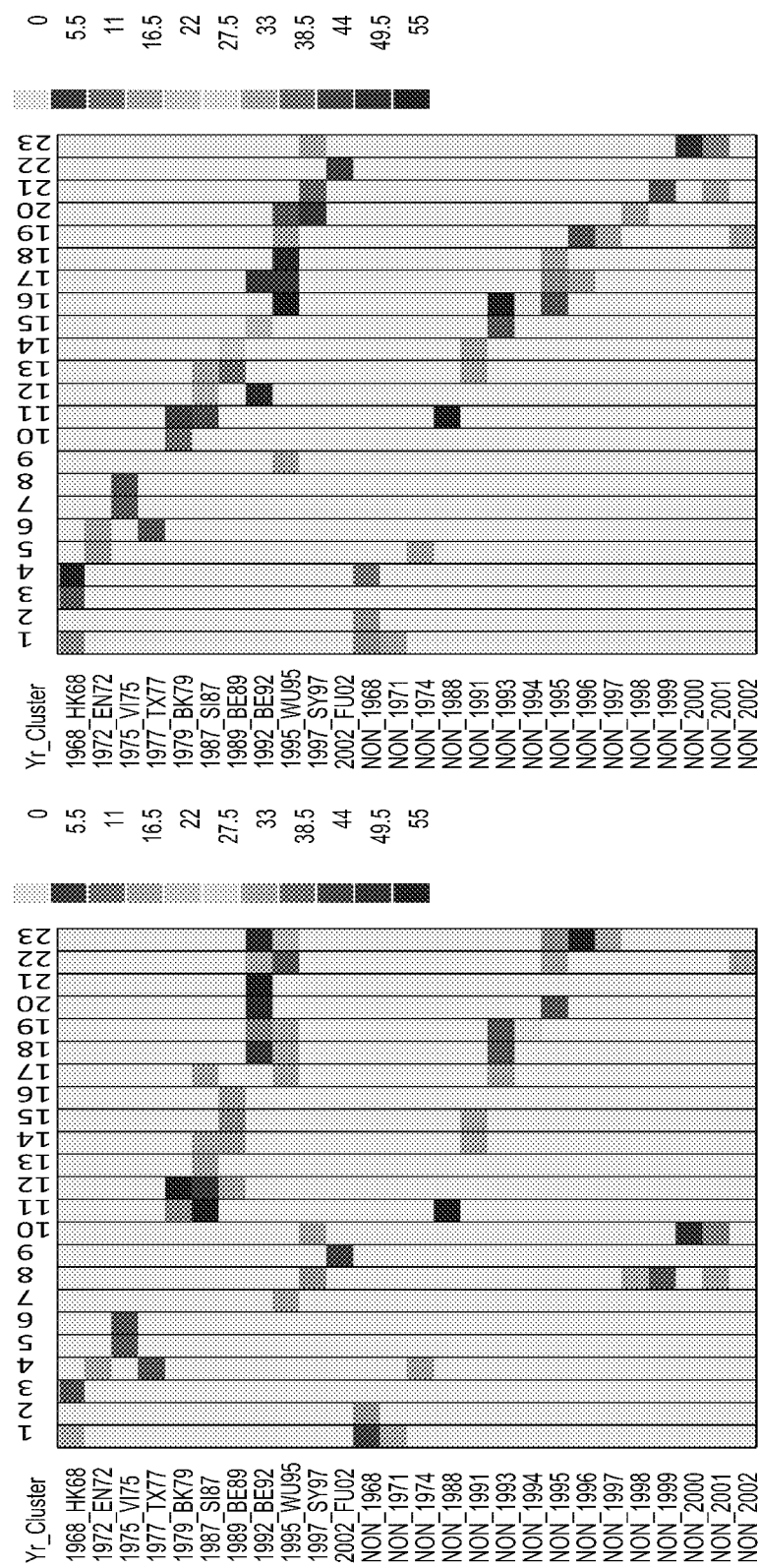

FIG. 29 shows a contingency plot for the clustering of binding patterns of Influenza H3N2 hemagglutinin epitopes to A*0201 and DRB1*0401.

FIG. 30 shows that binding affinity changes in Influenza H3N2 hemagglutinin were found arising from 1 to 7 amino acid changes within any given 15-mer peptide.

FIGS. 31A and 31B provide an example of the data set from FIG. 30 that shows binding affinity changes in Influenza H3N2 hemagglutinin were found arising from 1 to 7 amino acid changes within any given 15-mer peptide.

Figure 32:
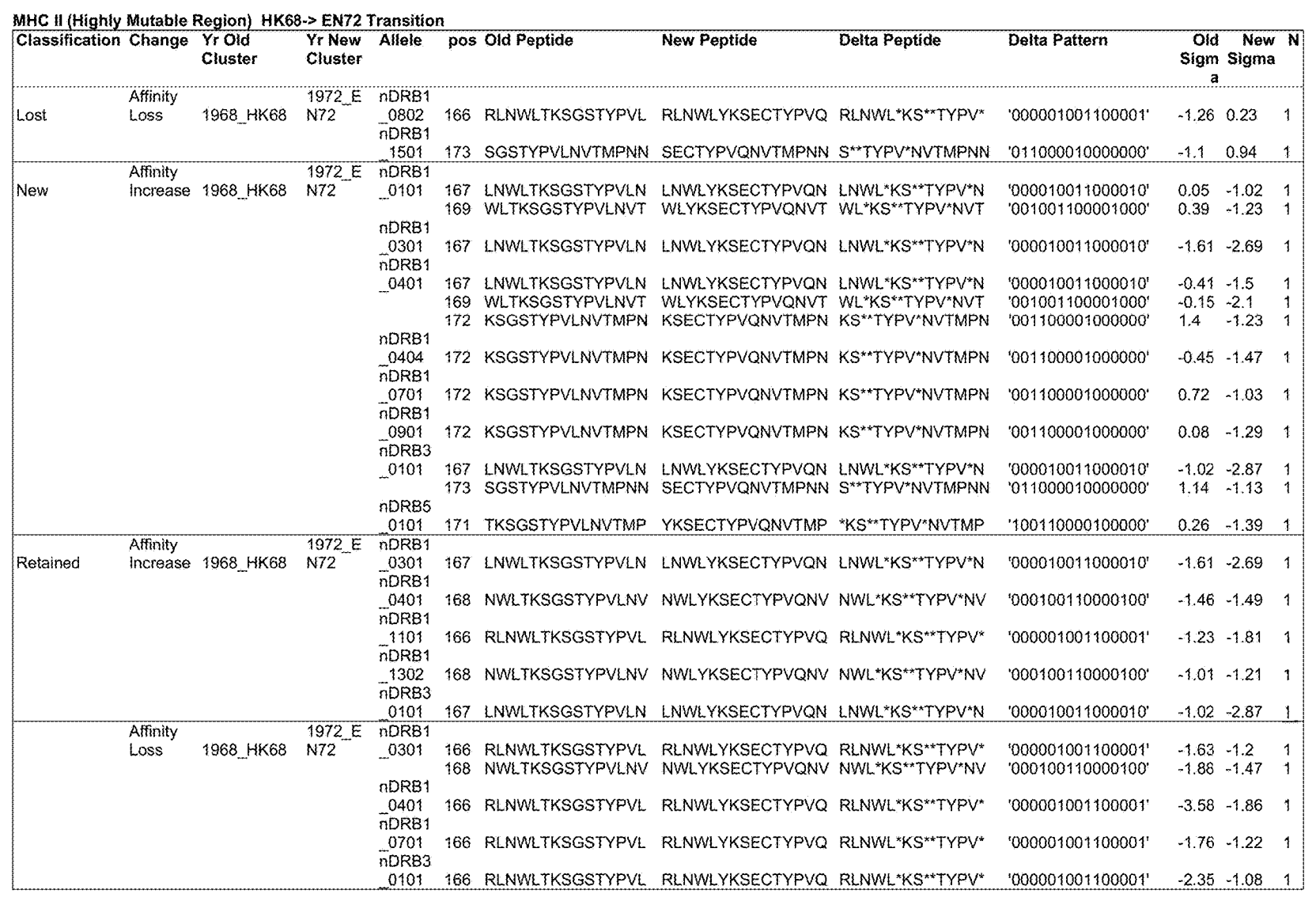

FIG. 32 is an example of the data set from FIG. 30 that shows binding affinity changes in Influenza H3N2 hemagglutinin were found arising from 1 to 7 amino acid changes within any given 15-mer peptide.

Figure 33A:
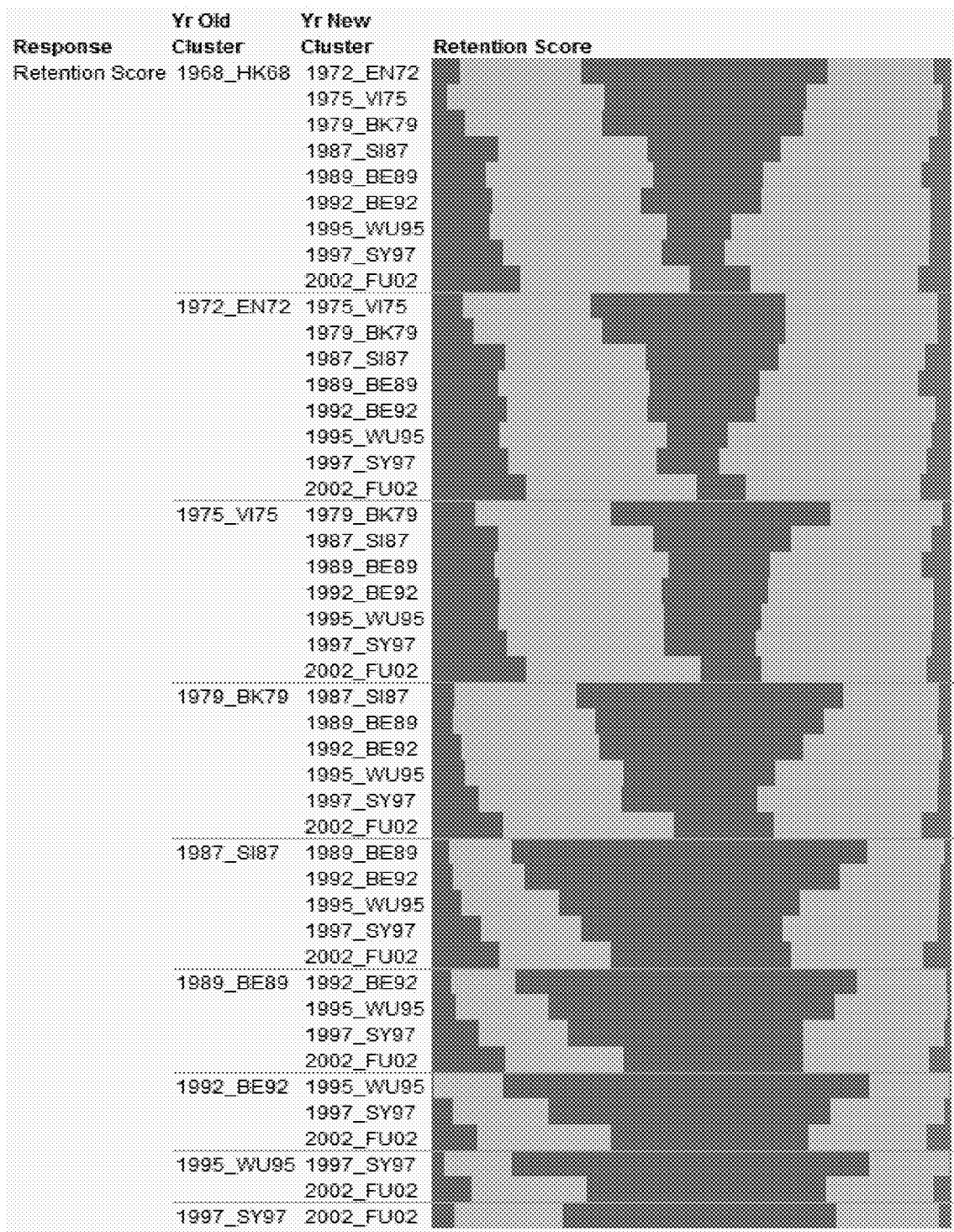
Figure 33B:
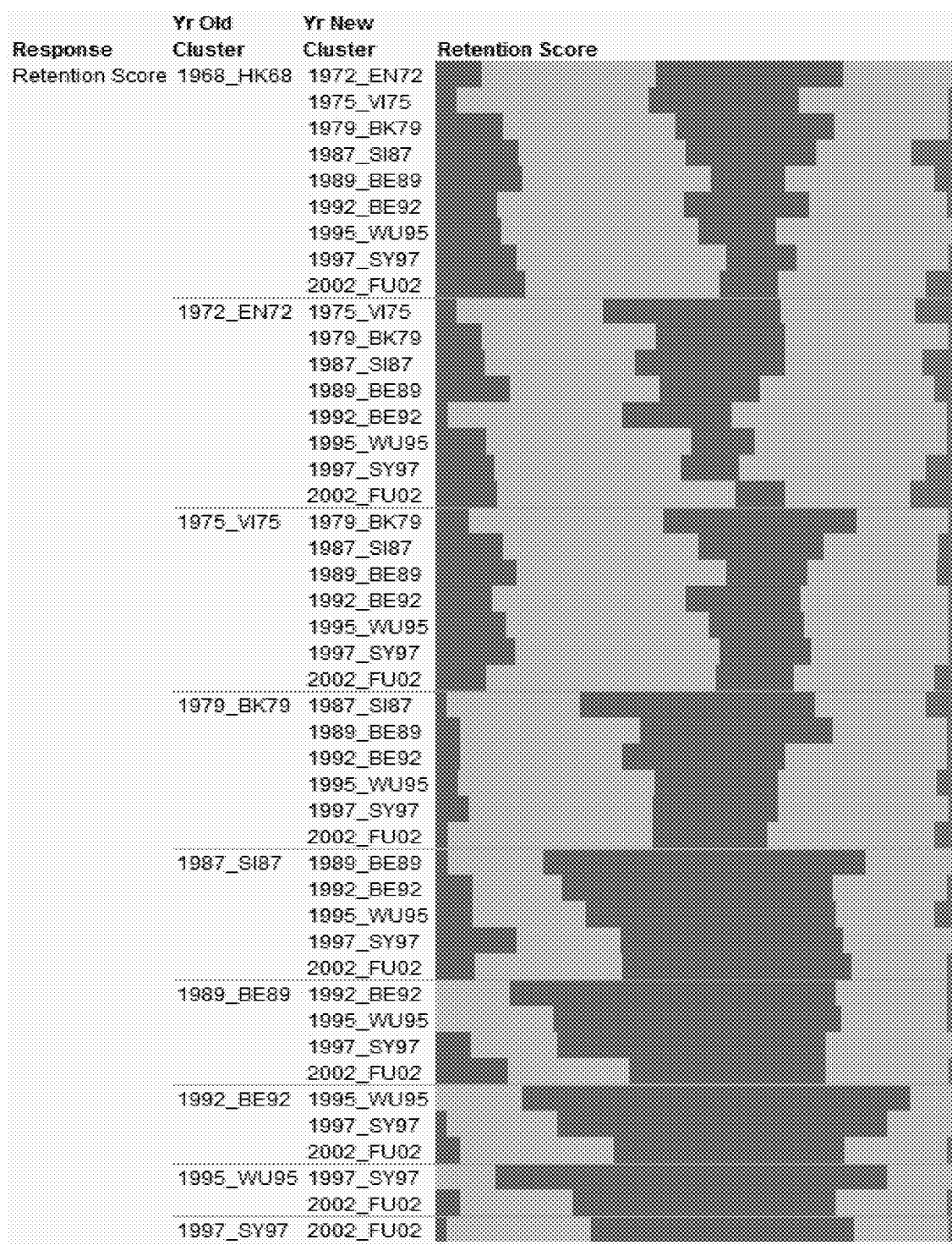

FIGS. 33A and 34B show the aggregate change in MHC-II binding peptides at each cluster transition, as represented by the subset of ten Influenza H3N2 hemagglutinin viruses for all MHC alleles. FIG. 33B shows the aggregate changes for DRB1*0401 as one example of the pattern derived for each allele.

Figure 34:
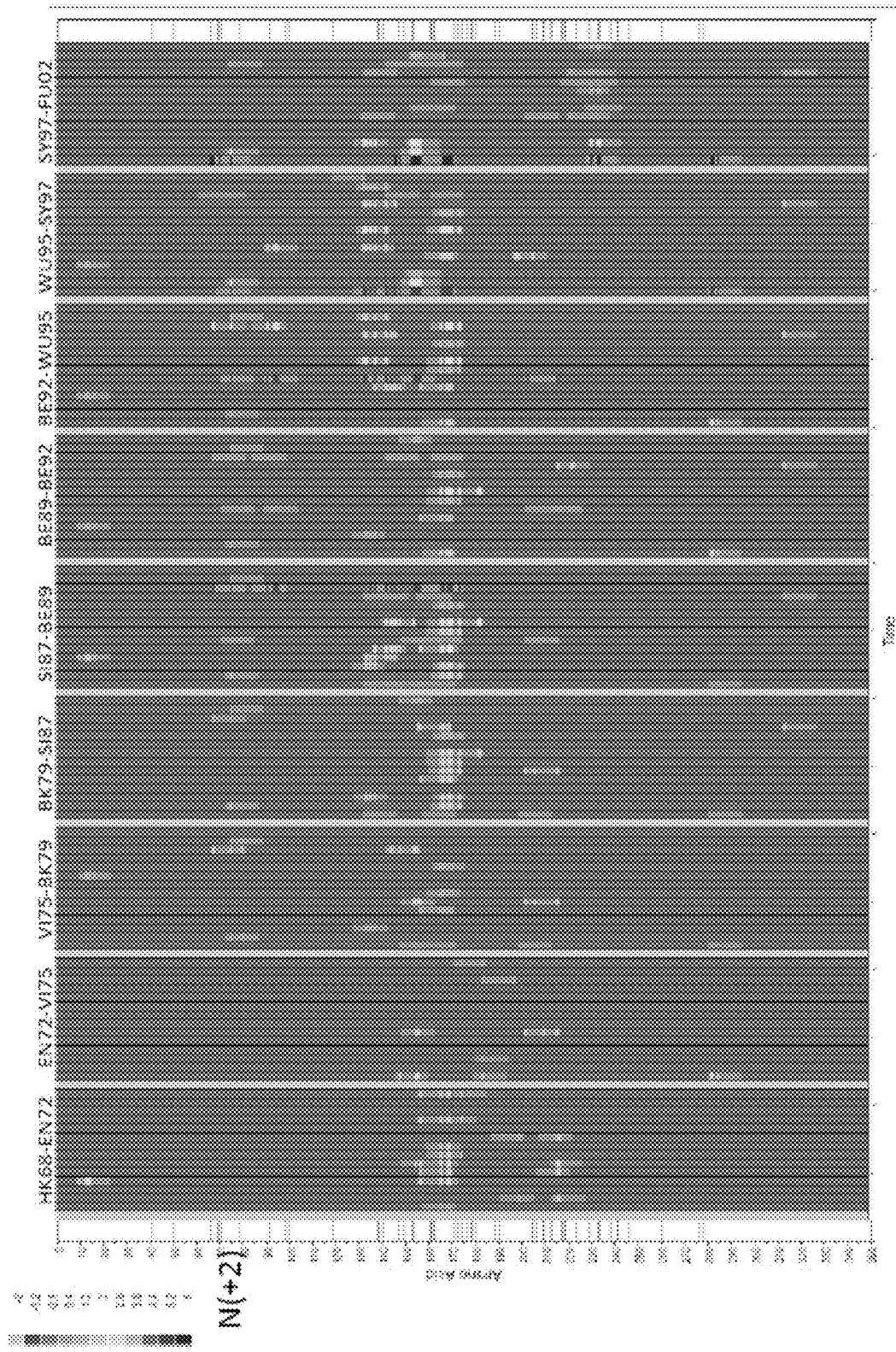
Figure 35:
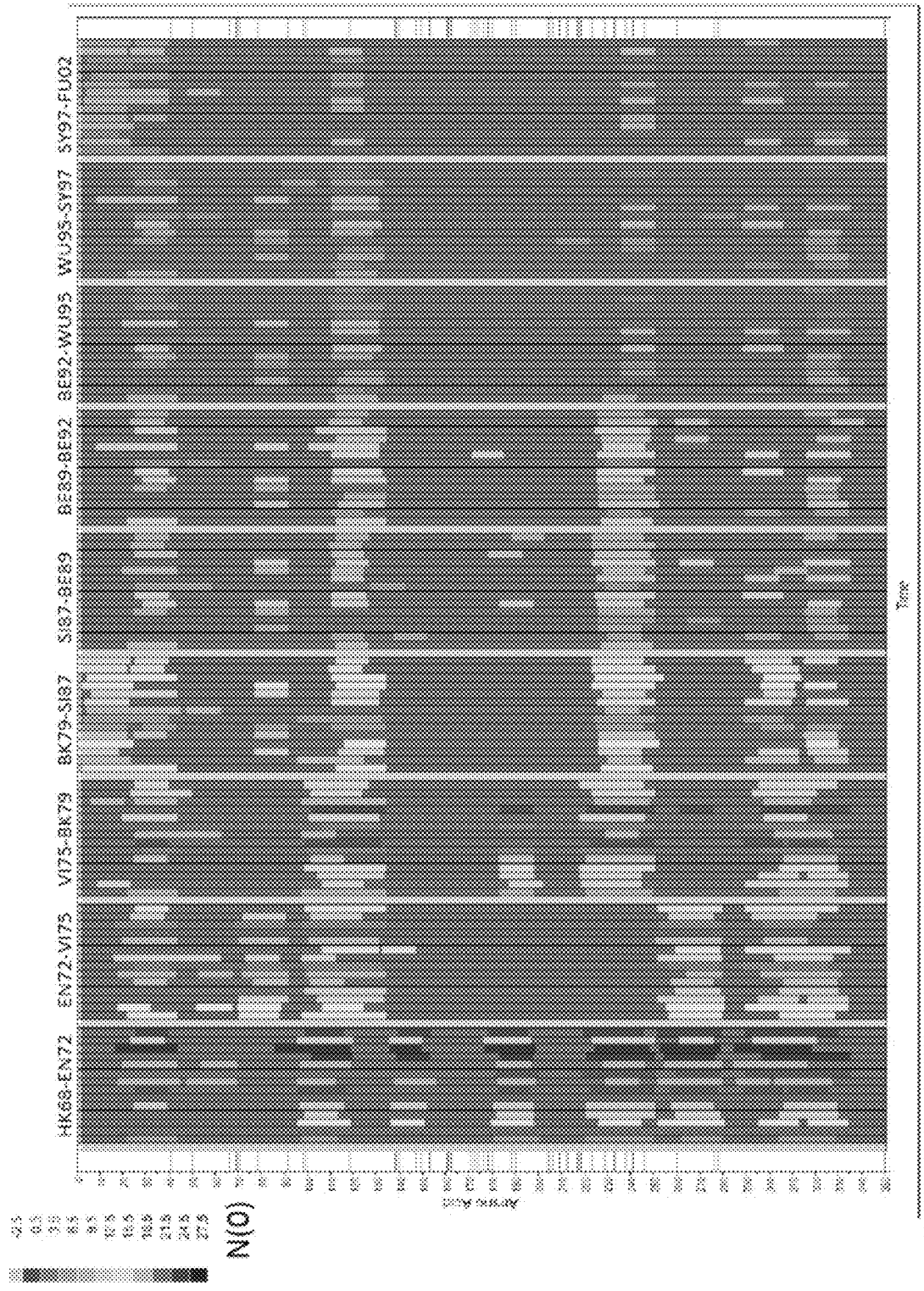
Figure 36:
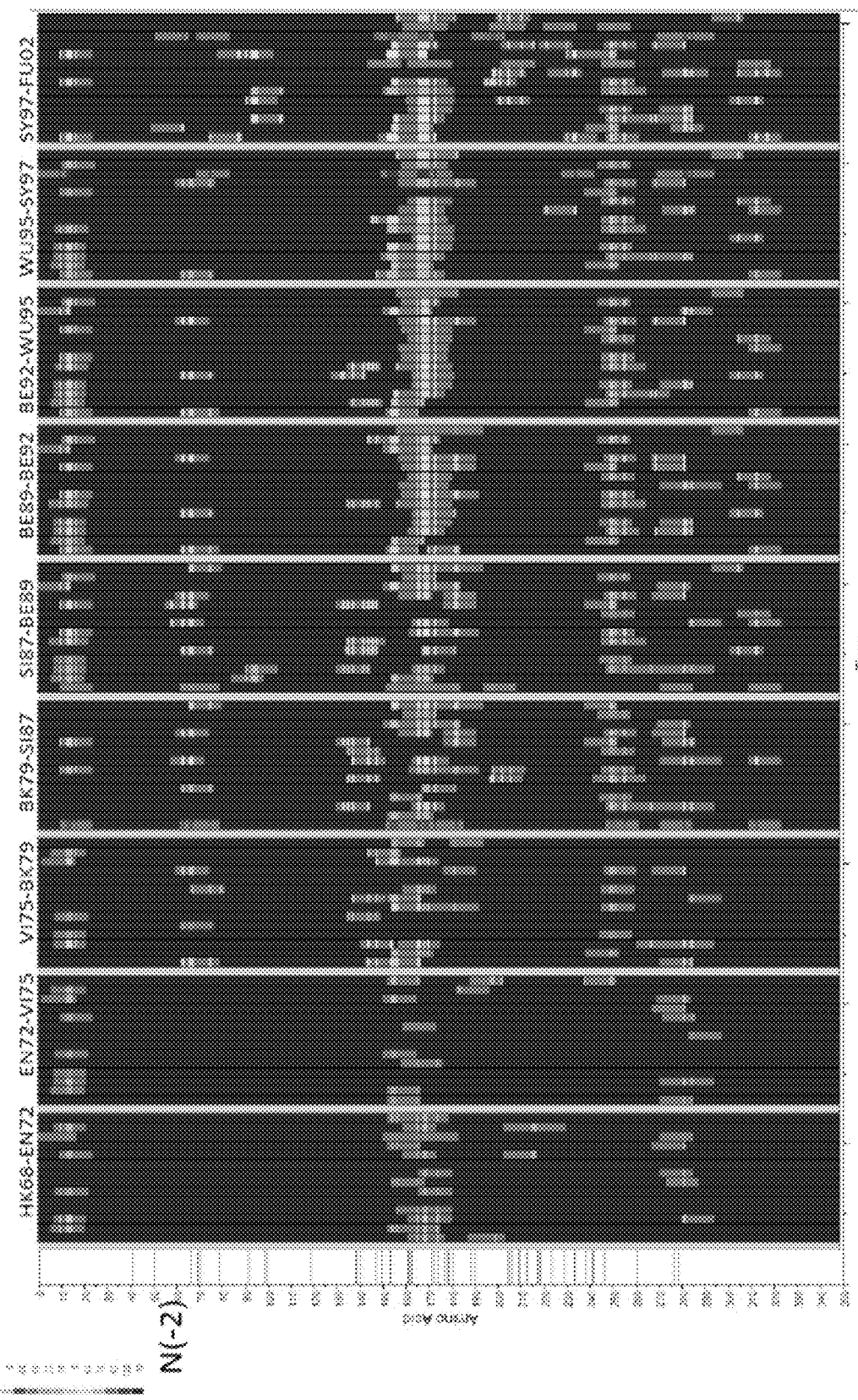

FIG. 34 shows the cumulative addition of high binding peptides across the nine cluster transitions of Influenza H3N2 hemagglutinin for each MHC-II allele FIG. 35 shows high binding affinity lost by each allele over the same transitions;

FIG. 36 maps the high MHC binding affinity sites retained.

FIG. 37 shows the process for detection of peptides in rotavirus VP7 which serve as potential mimics in IA2.

FIGS. 38A, 38B, and 38C provide overlay epitope maps of locus I1L (GI:68275867) from Vaccinia virus Western Reserve. (A) Vertical lines (dark red) are the N-terminal positions of predicted high affinity binding 9-mer peptides for A*0201 predicted by neural net regression. (B) Vertical lines are the N-terminal positions of predicted high affinity binding 9-mer peptides for A*1101 (red) and B*0702 (blue) predicted by neural net regression. (C) Higher resolution showing fine detail of A*0201 mapping. In all three panels the experimental overlay is for MHC-I 9-mer peptides mapped in HLA A*0201/Kb transgenic mice. Pasquetto et al., (2005) J Immunol 175: 5504-5515. The orange line is the predicted B-cell epitope probability for the particular amino acid being within a B-cell epitope. Actual computed data points are plotted along with the line that is the result of smoothing with a polynomial filter. Savitzky and Golay (1964) Anal Chem 36: 1627-1639. Blue horizontal bands are the regions of high probability MHC-II binding phenotype and orange horizontal bars are high probability predicted B-cell epitope regions. The percentile probabilities used as the threshold are as described in the text and is indicated in the number within the box at the left. Background is unshaded because this protein is predicted to lack any membrane domains.

Figure 5A:
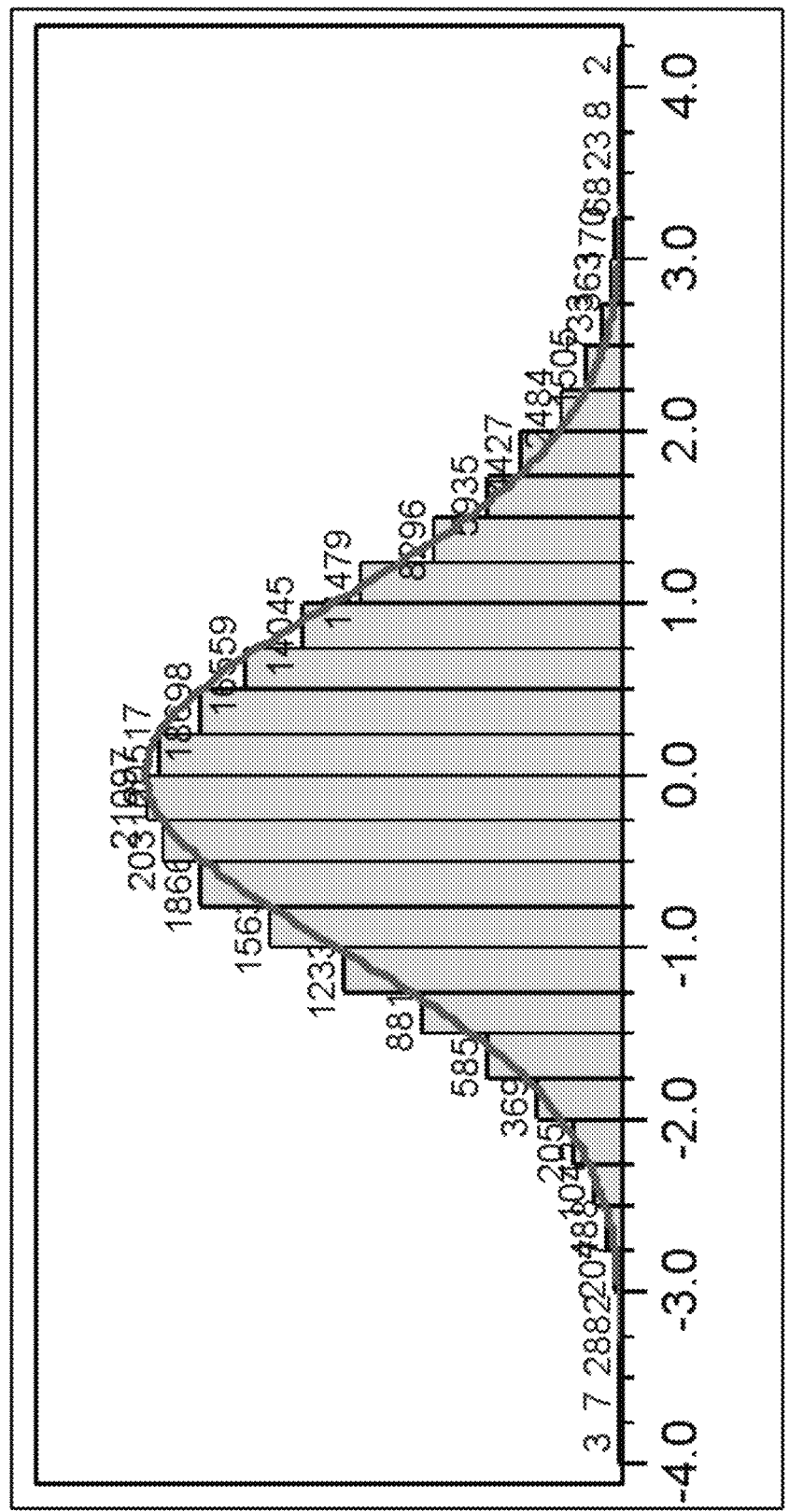
FIGS. 5A and 5B provide comparisons of distributions of globally standardized binding affinities with zero mean and unit standard deviation with the same data averaged by individual protein with a histogram of the individual protein population displayed. A Normal curve is superimposed on the histogram.
Figure 5B:
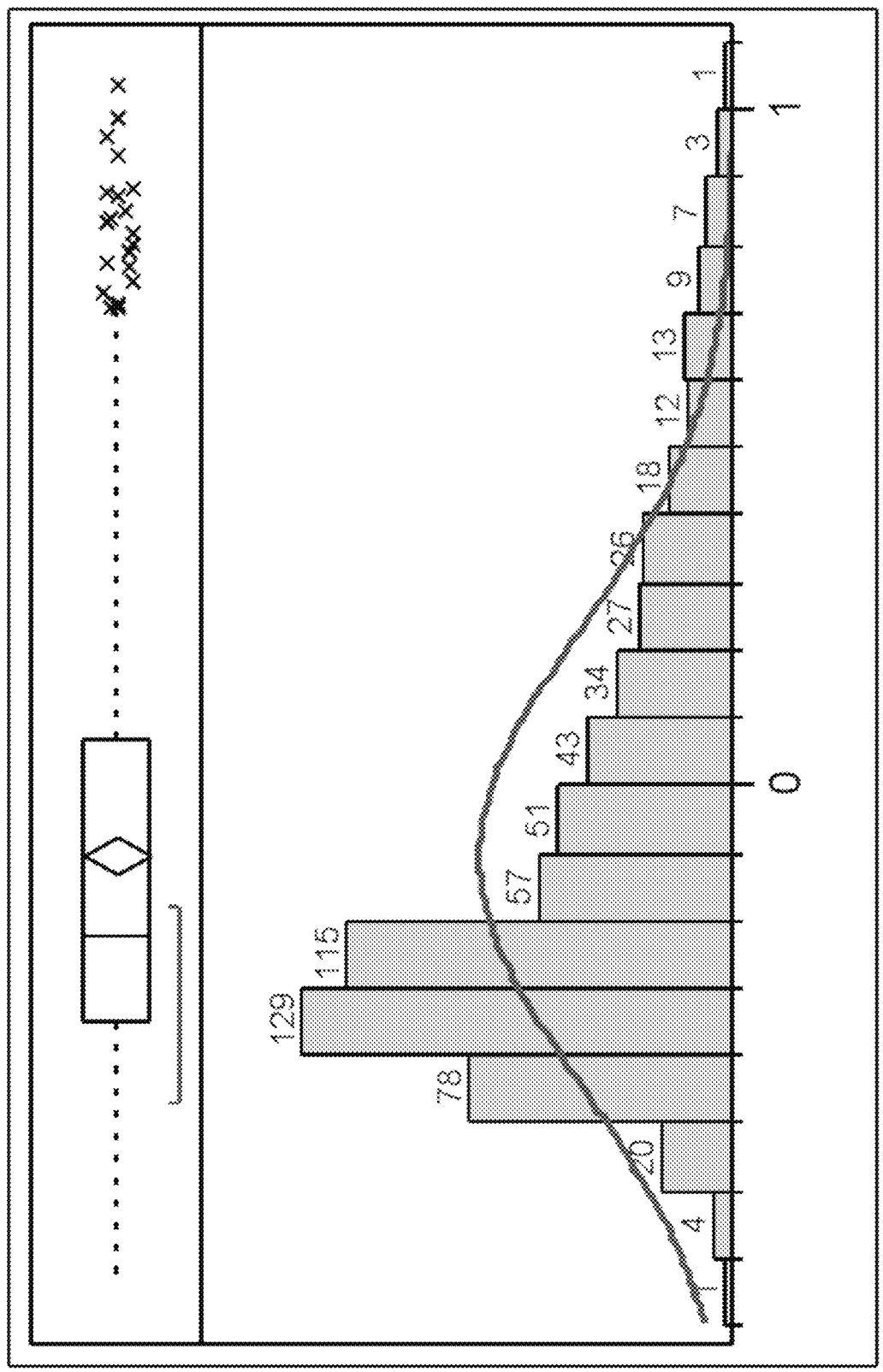
Figure 39:
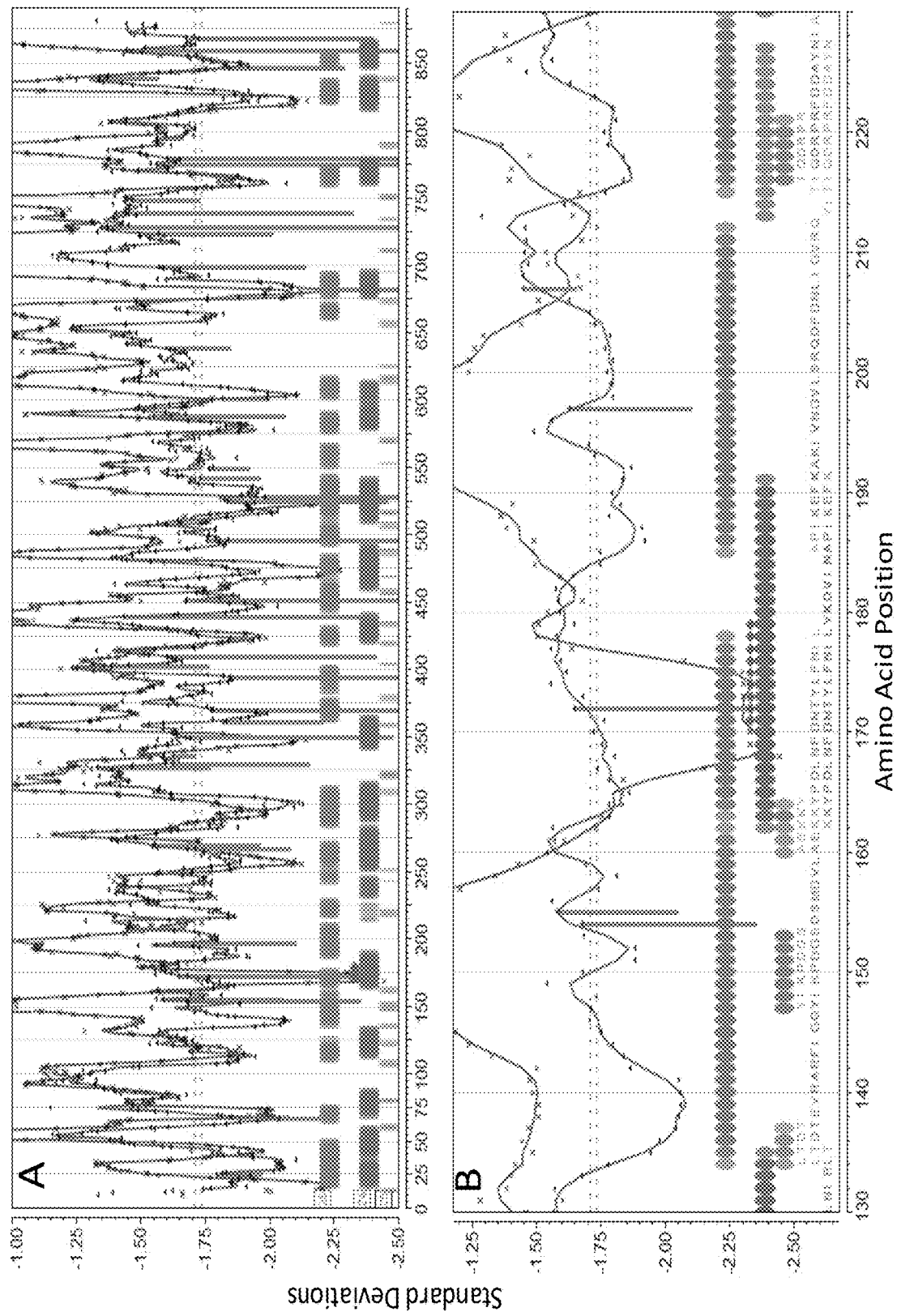

FIG. 39 provides overlay epitope maps of locus A10L (GI:68275926) from Vaccinia virus Western Reserve. Overlay is shown at two different resolutions showing MHC-I 9-mer peptides mapped in HLA A*1101/Kb transgenic mice. Pasquetto et al., (2005) J Immunol 175: 5504-5515. Symbols as described in FIG. 5. Vertical lines are the N-terminal positions of predicted high affinity binding 9-mer peptides for B*1101 predicted by neural net regression. Background is unshaded because this protein is predicted to lack any membrane domains.

Figure 40:
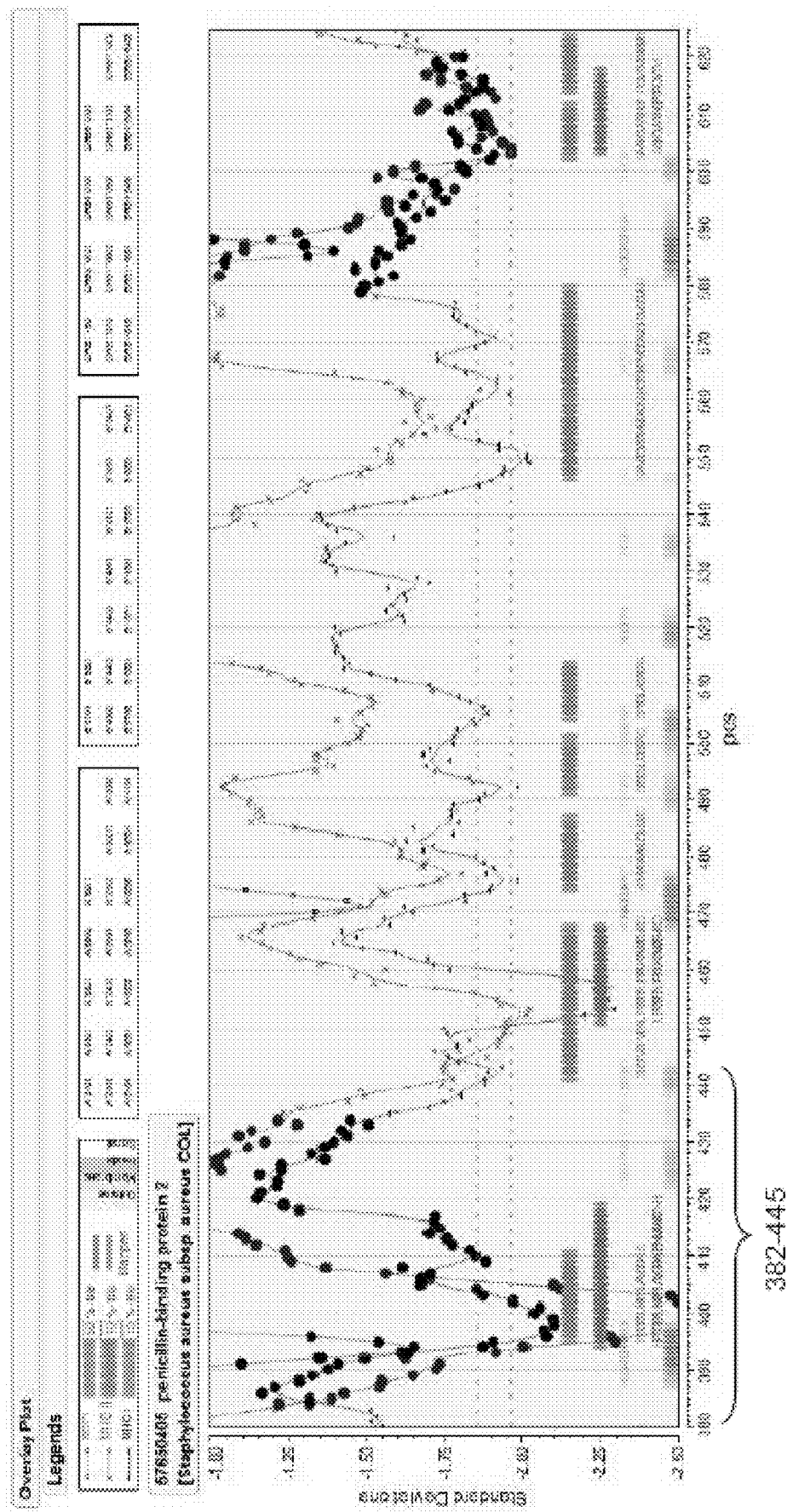

FIG. 40 is a chart for *S. aureus* penicillin-binding protein II (Genetic Index 57650405) showing the predicted population phenotype and the amino acids to be included in the reverse genetics process to produce the peptides in the laboratory. Symbols are as follows: Blue line: 10-percentile permuted human MHC-II (105 allelic combinations); Red line: 10 percentile permuted human MHC-I (630 allelic combinations). The blue horizontal bands depict the extent of 15-mers that meet the 10-percentile criteria for MHC-II. The gray horizontal bands indicate the extent of 9-mers that meet the 10-percentile criteria for MHC-I. The orange bands indicate the $50^{th}$ percentile Bayesian probability for the particular amino acid being part of a B-cell epitope. The black dots superimposed on the red and blue lines indicate where there is an overlap of both of the MHC and B-cell epitope sequence regions. The region selected for inclusion is indicated by the bracket below.

Figure 41:
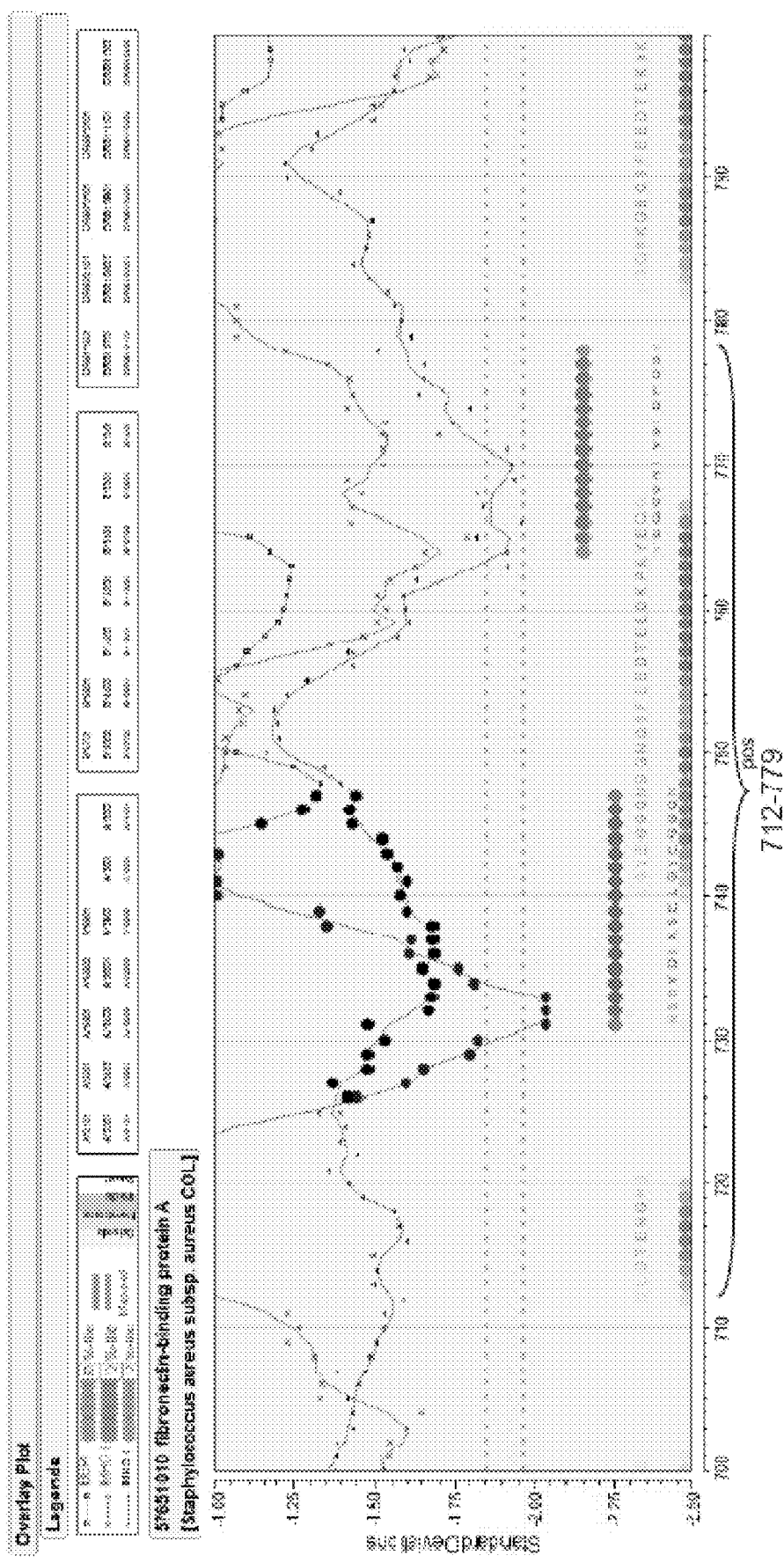

FIG. 41 is a chart for *S. aureus* fibronectin-binding protein A (Genetic Index 57651010) showing the predicted population phenotype and the amino acids to be included in the reverse genetics process to produce the peptides in the laboratory. Symbols are as follows: Blue line: 10-percentile permuted human MHC-II (105 allelic combinations); Red line: 10 percentile permuted human MHC-I (630 allelic combinations). The blue horizontal bands depict the extent of 15-mers that meet the 10-percentile criteria for MHC-II. The gray horizontal bands indicate the extent of 9-mers that meet the 10-percentile criteria for MHC-I. The orange bands indicate the $50^{th}$ percentile Bayesian probability for the particular amino acid being part of a B-cell epitope. The black dots superimposed on the red and blue lines indicate where there is an overlap of both of the MHC and B-cell epitope sequence regions. The region selected for inclusion is indicated by the bracket below.

Figure 42:
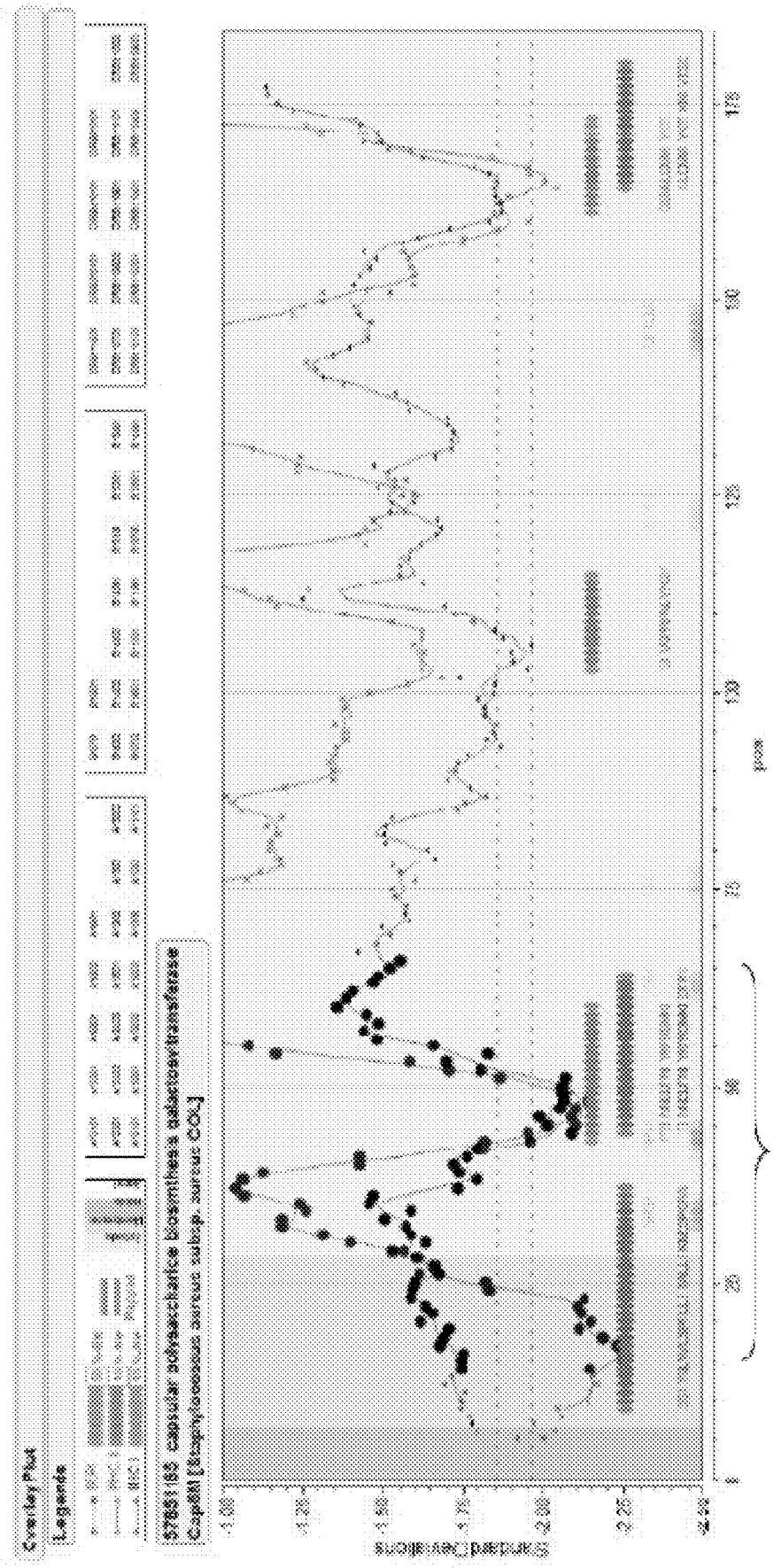

FIG. 42 is a chart for *S. aureus* Cap5M (Genetic Index 57651165) showing the predicted population phenotype and the amino acids to be included in the reverse genetics process to produce the peptides in the laboratory. Symbols are as follows: Blue line: 10-percentile permuted human MHC-II (105 allelic combinations); Red line: 10 percentile permuted human MHC-I (630 allelic combinations). The blue horizontal bands depict the extent of 15-mers that meet the 10-percentile criteria for MHC-II. The gray horizontal bands indicate the extent of 9-mers that meet the 10-percentile criteria for MHC-I. The orange bands indicate the $50^{th}$ percentile Bayesian probability for the particular amino acid being part of a B-cell epitope. The black dots superimposed on the red and blue lines indicate where there is an overlap of both of the MHC and BEPI regions. The region selected for inclusion is indicated by the bracket below.

Figure 43:
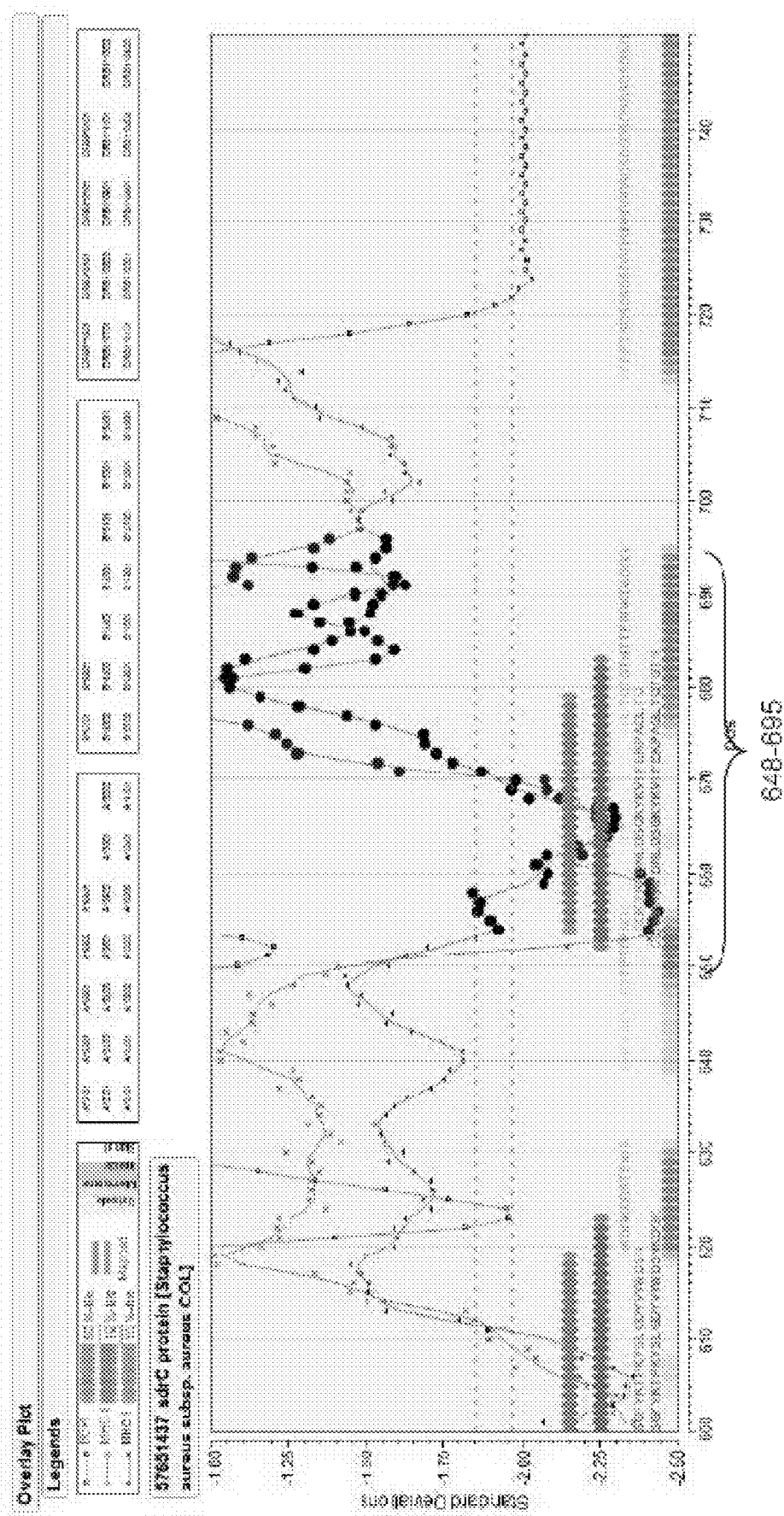

FIG. 43 is a chart for *Staph. aureus* sdrC protein (Genetic Index 57651437) showing the predicted population phenotype and the amino acids to be included in the reverse genetics process to produce the peptides in the laboratory. Symbols are as follows: Blue line: 10-percentile permuted human MHC-II (105 allelic combinations); Red line: 10 percentile permuted human MHC-I (630 allelic combinations). The blue horizontal bands depict the extent of 15-mers that meet the 10-percentile criteria for MHC-II. The gray horizontal bands indicate the extent of 9-mers that meet the 10-percentile criteria for MHC-I. The orange bands indicate the $50^{th}$ percentile Bayesian probability for the particular amino acid being part of a B-cell epitope. The black dots superimposed on the red and blue lines indicate where there is an overlap of both of the MHC and B-cell epitope sequence regions. The region selected for inclusion is indicated by the bracket below.

Figure 44:
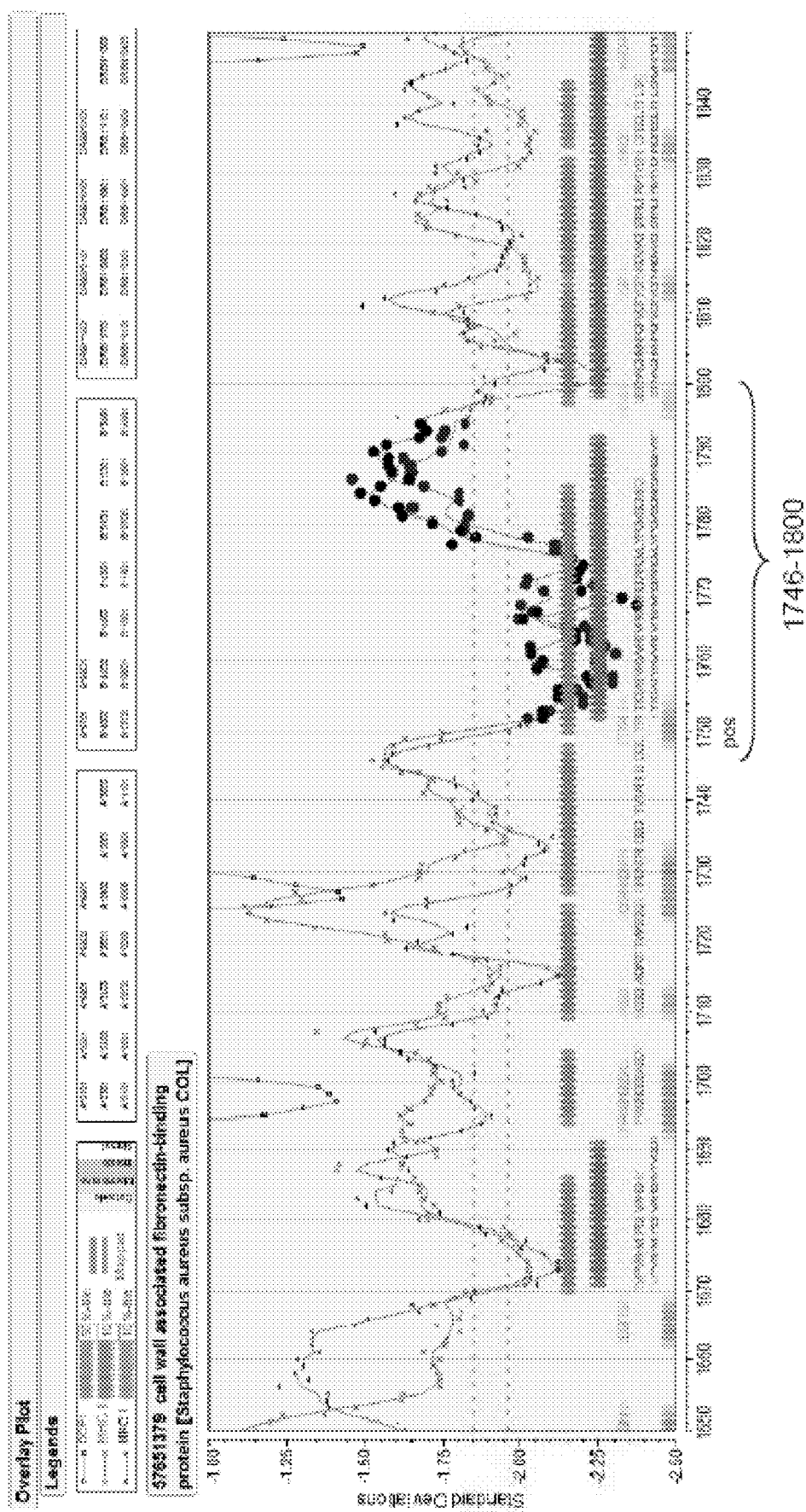

FIG. 44 is a chart for *S. aureus* cell wall-associated fibronectin binding protein (Genetic Index 57651379) showing the predicted population phenotype and the amino acids to be included in the reverse genetics process to produce the peptides in the laboratory. Symbols are as follows: Blue line: 10-percentile permuted human MHC-II (105 allelic combinations); Red line: 10 percentile permuted human MHC-I (630 allelic combinations). The blue horizontal bands depict the extent of 15-mers that meet the 10-percentile criteria for MHC-II. The gray horizontal bands indicate the extent of 9-mers that meet the 10-percentile criteria for MHC-I. The orange bands indicate the $50^{th}$ percentile Bayesian probability for the particular amino acid being part of a B-cell epitope. The black dots superimposed on the red and blue lines indicate where there is an overlap of both of the MHC and B-cell epitope sequence regions. The region selected for inclusion is indicated by the bracket below.

DEFINITIONS

As used herein, the term "genome" refers to the genetic material (e.g., chromosomes) of an organism or a host cell.

As used herein, the term "proteome" refers to the entire set of proteins expressed by a genome, cell, tissue or organism. A "partial proteome" refers to a subset the entire set of proteins expressed by a genome, cell, tissue or organism. Examples of "partial proteomes" include, but are not limited to, transmembrane proteins, secreted proteins, and proteins with a membrane motif.

As used herein, the terms "protein," "polypeptide," and "peptide" refer to a molecule comprising amino acids joined via peptide bonds. In general "peptide" is used to refer to a sequence of 20 or less amino acids and "polypeptide" is used to refer to a sequence of greater than 20 amino acids.

As used herein, the term, "synthetic polypeptide," "synthetic peptide" and "synthetic protein" refer to peptides, polypeptides, and proteins that are produced by a recombinant process (i.e., expression of exogenous nucleic acid encoding the peptide, polypeptide or protein in an organism, host cell, or cell-free system) or by chemical synthesis.

As used herein, the term "protein of interest" refers to a protein encoded by a nucleic acid of interest.

As used herein, the term "native" (or wild type) when used in reference to a protein refers to proteins encoded by the genome of a cell, tissue, or organism, other than one manipulated to produce synthetic proteins.

As used herein, the term "B-cell epitope" refers to a polypeptide sequence that is recognized and bound by a B-cell receptor. A B-cell epitope may be a linear peptide or may comprise several discontinuous sequences which together are folded to form a structural epitope. Such component sequences which together make up a B-cell epitope are referred to herein as B-cell epitope sequences. Hence, a B cell epitope may comprise one or more B-cell epitope sequences.

As used herein, the term "predicted B-cell epitope" refers to a polypeptide sequence that is predicted to bind to a B-cell receptor by a computer program, for example, in addition to methods described herein, Bepipred (Larsen, et al., Immunome Research 2:2, 2006.) and others as referenced by Larsen et al (ibid) (Hopp T et al PNAS 78:3824-3828, 1981; Parker J et al, Biochem. 25:5425-5432, 1986). A predicted B-cell epitope may refer to the identification of B-cell epitope sequences forming part of a structural B-cell epitope or to a complete B-cell epitope.

As used herein, the term "T-cell epitope" refers to a polypeptide sequence bound to a major histocompatibility protein molecule in a configuration recognized by a T-cell receptor. Typically, T-cell epitopes are presented on the surface of an antigen-presenting cell.

As used herein, the term "predicted T-cell epitope" refers to a polypeptide sequence that is predicted to bind to a major histocompatibility protein molecule by the neural network algorithms described herein or as determined experimentally.

As used herein, the term "major histocompatibility complex (MHC)" refers to the MHC Class I and MHC Class II genes and the proteins encoded thereby. Molecules of the MHC bind small peptides and present them on the surface of cells for recognition by T-cell receptor-bearing T-cells. The MHC is both polygenic (there are several MHC class I and MHC class II genes) and polymorphic (there are multiple alleles of each gene). The terms MHC-I MHC-II MHC-1 and MHC-2 are variously used herein to indicate these classes of molecules. Included are both classical and non-classical MHC molecules. An MHC molecule is made up of multiple chains (alpha and beta chains) which associate to form a molecule. The MHC molecule contains a cleft which forms a binding site for peptides. Peptides bound in the cleft may then be presented to T-cell receptors. The term "MHC binding region" refers to the cleft region of the MHC molecule where peptide binding occurs.

As used herein, the term "haplotype" refers to the HLA alleles found on one chromosome and the proteins encoded thereby. Haplotype may also refer to the allele present at any one locus within the MHC. Each class of MHC is represented by several loci: e.g., HLA-A (Human Leukocyte Antigen-A), HLA-B, HLA-C, HLA-E, HLA-F, HLA-G, HLA-H, HLA-J, HLA-K, HLA-L, HLA-P and HLA-V for class I and HLA-DRA, HLA-DRB1-9, HLA-, HLA-DQA1, HLA-DQB1, HLA-DPA1, HLA-DPB1, HLA-DMA, HLA-DMB, HLA-DOA, and HLA-DOB for class II. The terms "HLA allele" and "MHC allele" are used interchangeably herein. HLA alleles are listed at hla.alleles.org/nomenclature/naming.html, which is incorporated herein by reference.

The MHCs exhibit extreme polymorphism: within the human population there are, at each genetic locus, a great number of haplotypes comprising distinct alleles—the IMGT/HLA database release (February 2010) lists 948 class I and 633 class II molecules, many of which are represented at high frequency (>1%). MHC alleles may differ by as many as 30-aa substitutions. Different polymorphic MHC alleles, of both class I and class II, have different peptide specificities: each allele encodes proteins that bind peptides exhibiting particular sequence patterns.

The naming of new HLA genes and allele sequences and their quality control is the responsibility of the WHO Nomenclature Committee for Factors of the HLA System, which first met in 1968, and laid down the criteria for successive meetings. This committee meets regularly to discuss issues of nomenclature and has published 19 major reports documenting firstly the HLA antigens and more recently the genes and alleles. The standardization of HLA antigenic specifications has been controlled by the exchange of typing reagents and cells in the International Histocompatibility Workshops. The IMGT/HLA Database collects both new and confirmatory sequences, which are then expertly analyzed and curated before been named by the Nomenclature Committee. The resulting sequences are then included in the tools and files made available from both the IMGT/HLA Database and at hla.alleles.org.

Each HLA allele name has a unique number corresponding to up to four sets of digits separated by colons. See e.g., hla.alleles.org/nomenclature/naming.html which provides a description of standard HLA nomenclature and Marsh et al., Nomenclature for Factors of the HLA System, 2010 Tissue Antigens 2010 75:291-455. HLA-DRB1*13:01 and HLA-DRB1*13:01:01:02 are examples of standard HLA nomenclature. The length of the allele designation is dependent on the sequence of the allele and that of its nearest relative. All alleles receive at least a four digit name, which corresponds to the first two sets of digits, longer names are only assigned when necessary.

The digits before the first colon describe the type, which often corresponds to the serological antigen carried by an allotype, The next set of digits are used to list the subtypes, numbers being assigned in the order in which DNA sequences have been determined. Alleles whose numbers differ in the two sets of digits must differ in one or more nucleotide substitutions that change the amino acid sequence of the encoded protein. Alleles that differ only by synonymous nucleotide substitutions (also called silent or non-coding substitutions) within the coding sequence are distinguished by the use of the third set of digits. Alleles that only differ by sequence polymorphisms in the introns or in the 5' or 3' untranslated regions that flank the exons and introns are distinguished by the use of the fourth set of digits. In addition to the unique allele number there are additional optional suffixes that may be added to an allele to indicate its expression status. Alleles that have been shown not to be expressed, 'Null' alleles have been given the suffix 'N'. Those alleles which have been shown to be alternatively expressed may have the suffix 'L', 'S', 'C', 'A' or 'Q'. The suffix 'L' is used to indicate an allele which has been shown to have 'Low' cell surface expression when compared to normal levels. The 'S' suffix is used to denote an allele specifying a protein which is expressed as a soluble 'Secreted' molecule but is not present on the cell surface. A 'C' suffix to indicate an allele product which is present in the 'Cytoplasm' but not on the cell surface. An 'A' suffix to indicate 'Aberrant' expression where there is some doubt as to whether a protein is expressed. A 'Q' suffix when the expression of an allele is 'Questionable' given that the mutation seen in the allele has previously been shown to affect normal expression levels.

In some instances, the HLA designations used herein may differ from the standard HLA nomenclature just described due to limitations in entering characters in the databases described herein. As an example, DRB1_0104, DRB1*0104, and DRB1-0104 are equivalent to the standard nomenclature of DRB1*01:04. In most instances, the asterisk is replaced with an underscore or dash and the semicolon between the two digit sets is omitted.

As used herein, the term "polypeptide sequence that binds to at least one major histocompatibility complex (MHC) binding region" refers to a polypeptide sequence that is recognized and bound by one more particular MHC binding regions as predicted by the neural network algorithms described herein or as determined experimentally.

As used herein, the term "allergen" refers to an antigenic substance capable of producing immediate hypersensitivity and includes both synthetic as well as natural immunostimulant peptides and proteins.

As used herein, the term "transmembrane protein" refers to proteins that span a biological membrane. There are two basic types of transmembrane proteins. Alpha-helical proteins are present in the inner membranes of bacterial cells or the plasma membrane of eukaryotes, and sometimes in the outer membranes. Beta-barrel proteins are found only in outer membranes of Gram-negative bacteria, cell wall of Gram-positive bacteria, and outer membranes of mitochondria and chloroplasts.

As used herein, the term "external loop portion" refers to the portion of transmembrane protein that is positioned between two membrane-spanning portions of the transmembrane protein and projects outside of the membrane of a cell.

As used herein, the term "tail portion" refers to refers to an n-terminal or c-terminal portion of a transmembrane protein that terminates in the inside ("internal tail portion") or outside ("external tail portion") of the cell membrane.

As used herein, the term "secreted protein" refers to a protein that is secreted from a cell.

As used herein, the term "membrane motif" refers to an amino acid sequence that encodes a motif not a canonical transmembrane domain but which would be expected by its function deduced in relation to other similar proteins to be located in a cell membrane, such as those listed in the publically available psortb database.

As used herein, the term "consensus protease cleavage site" refers to an amino acid sequence that is recognized by a protease such as trypsin or pepsin.

As used herein, the term "affinity" refers to a measure of the strength of binding between two members of a binding pair, for example, an antibody and an epitope and an epitope and a MHC-I or II haplotype. $K_d$ is the dissociation constant and has units of molarity. The affinity constant is the inverse of the dissociation constant. An affinity constant is sometimes used as a generic term to describe this chemical entity. It is a direct measure of the energy of binding. The natural logarithm of K is linearly related to the Gibbs free energy of binding through the equation $\Delta G_0 = -RT\ LN(K)$ where R=gas constant and temperature is in degrees Kelvin. Affinity may be determined experimentally, for example by surface plasmon resonance (SPR) using commercially available Biacore SPR units (GE Healthcare) or in silico by methods such as those described herein in detail. Affinity may also be expressed as the ic50 or inhibitory concentration 50, that concentration at which 50% of the peptide is displaced. Likewise ln(ic50) refers to the natural log of the ic50.

The term "$K_{off}$", as used herein, is intended to refer to the off rate constant, for example, for dissociation of an antibody from the antibody/antigen complex, or for dissociation of an epitope from an MHC haplotype.

The term "$K_d$", as used herein, is intended to refer to the dissociation constant (the reciprocal of the affinity constant "Ka"), for example, for a particular antibody-antigen interaction or interaction between an epitope and an MHC haplotype.

As used herein, the terms "strong binder" and "strong binding" refer to a binding pair or describe a binding pair that have an affinity of greater than $2\times10^7 M^{-1}$ (equivalent to a dissociation constant of 50 nM Kd)

As used herein, the term "moderate binder" and "moderate binding" refer to a binding pair or describe a binding pair that have an affinity of from $2\times10^7 M^{-1}$ to $2\times10^6 M^{-1}$.

As used herein, the terms "weak binder" and "weak binding" refer to a binding pair or describe a binding pair that have an affinity of less than $2\times10^6 M^{-1}$ (equivalent to a dissociation constant of 500 nM Kd)

The terms "specific binding" or "specifically binding" when used in reference to the interaction of an antibody and a protein or peptide or an epitope and an MHC haplotype means that the interaction is dependent upon the presence of a particular structure (i.e., the antigenic determinant or epitope) on the protein; in other words the antibody is recognizing and binding to a specific protein structure rather than to proteins in general. For example, if an antibody is specific for epitope "A," the presence of a protein containing epitope A (or free, unlabeled A) in a reaction containing labeled "A" and the antibody will reduce the amount of labeled A bound to the antibody.

As used herein, the term "antigen binding protein" refers to proteins that bind to a specific antigen. "Antigen binding proteins" include, but are not limited to, immunoglobulins, including polyclonal, monoclonal, chimeric, single chain, and humanized antibodies, Fab fragments, F(ab')2 fragments, and Fab expression libraries. Various procedures known in the art are used for the production of polyclonal antibodies. For the production of antibody, various host animals can be immunized by injection with the peptide corresponding to the desired epitope including but not limited to rabbits, mice, rats, sheep, goats, etc. Various adjuvants are used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (Bacille Calmette-Guerin) and *Corynebacterium parvum*.

For preparation of monoclonal antibodies, any technique that provides for the production of antibody molecules by continuous cell lines in culture may be used (See e.g., Harlow and Lane, Antibodies: A Laboratory Manual, Cold Spring Harbor Laboratory Press, Cold Spring Harbor, N.Y). These include, but are not limited to, the hybridoma technique originally developed by Kohler and Milstein (Kohler and Milstein, Nature, 256:495-497 [1975]), as well as the trioma technique, the human B-cell hybridoma technique (See e.g., Kozbor et al., Immunol. Today, 4:72 [1983]), and the EBV-hybridoma technique to produce human monoclonal antibodies (Cole et al., in Monoclonal Antibodies and Cancer Therapy, Alan R. Liss, Inc., pp. 77-96 [1985]). In other embodiments, suitable monoclonal antibodies, including recombinant chimeric monoclonal antibodies and chimeric monoclonal antibody fusion proteins are prepared as described herein.

According to the invention, techniques described for the production of single chain antibodies (U.S. Pat. No. 4,946,778; herein incorporated by reference) can be adapted to produce specific single chain antibodies as desired. An additional embodiment of the invention utilizes the techniques known in the art for the construction of Fab expression libraries (Huse et al., Science, 246:1275-1281 [1989]) to allow rapid and easy identification of monoclonal Fab fragments with the desired specificity.

Antibody fragments that contain the idiotype (antigen binding region) of the antibody molecule can be generated by known techniques. For example, such fragments include but are not limited to: the F(ab')2 fragment that can be produced by pepsin digestion of an antibody molecule; the Fab' fragments that can be generated by reducing the disulfide bridges of an F(ab')2 fragment, and the Fab fragments that can be generated by treating an antibody molecule with papain and a reducing agent.

Genes encoding antigen-binding proteins can be isolated by methods known in the art. In the production of antibodies, screening for the desired antibody can be accomplished by techniques known in the art (e.g., radioimmunoassay, ELISA (enzyme-linked immunosorbant assay), "sandwich" immunoassays, immunoradiometric assays, gel diffusion precipitin reactions, immunodiffusion assays, in situ immunoassays (using colloidal gold, enzyme or radioisotope labels, for example), Western Blots, precipitation reactions, agglutination assays (e.g., gel agglutination assays, hemagglutination assays, etc.), complement fixation assays, immunofluorescence assays, protein A assays, and immunoelectrophoresis assays, etc.) etc.

As used herein, the terms "computer memory" and "computer memory device" refer to any storage media readable by a computer processor. Examples of computer memory include, but are not limited to, RAM, ROM, computer chips, digital video disc (DVDs), compact discs (CDs), hard disk drives (HDD), and magnetic tape.

As used herein, the term "computer readable medium" refers to any device or system for storing and providing information (e.g., data and instructions) to a computer processor. Examples of computer readable media include, but are not limited to, DVDs, CDs, hard disk drives, magnetic tape and servers for streaming media over networks.

As used herein, the terms "processor" and "central processing unit" or "CPU" are used interchangeably and refer to a device that is able to read a program from a computer memory (e.g., ROM or other computer memory) and perform a set of steps according to the program.

As used herein, the term "neural network" refers to various configurations of classifiers used in machine learning, including multilayered perceptrons with one or more hidden layer, support vector machines and dynamic Bayesian networks. These methods share in common the ability to be trained, the quality of their training evaluated and their ability to make either categorical classifications or of continuous numbers in a regression mode.

As used herein, the term "principal component analysis" refers to a mathematical process which reduces the dimensionality of a set of data (Wold, S., Sjorstrom, M., and Eriksson, L., Chemometrics and Intelligent Laboratory Systems 2001. 58: 109-130; Multivariate and Megavariate Data Analysis Basic Principles and Applications (Parts I&II) by L. Eriksson, E. Johansson, N. Kettaneh-Wold, and J. Trygg, 2006 $2^{nd}$ Edit. Umetrics Academy). Derivation of principal components is a linear transformation that locates directions of maximum variance in the original input data, and rotates the data along these axes. For n original variables, n principal components are formed as follows: The first principal component is the linear combination of the standardized original variables that has the greatest possible variance. Each subsequent principal component is the linear combination of the standardized original variables that has the greatest possible variance and is uncorrelated with all previously defined components. Further, the principal components are scale-independent in that they can be developed from different types of measurements.

As used herein, the term "vector" when used in relation to a computer algorithm or the present invention, refers to the mathematical properties of the amino acid sequence.

As used herein, the term "vector," when used in relation to recombinant DNA technology, refers to any genetic element, such as a plasmid, phage, transposon, cosmid, chromosome, retrovirus, virion, etc., which is capable of replication when associated with the proper control elements and which can transfer gene sequences between cells. Thus, the term includes cloning and expression vehicles, as well as viral vectors.

As used herein, the terms "biocide" or "biocides" refer to at least a portion of a naturally occurring or synthetic molecule (e.g., peptides or enzymes) that directly kills or promotes the death and/or attenuation of (e.g., prevents growth and/or replication) of biological targets (e.g., bacteria, parasites, yeast, viruses, fungi, protozoas and the like). Examples of biocides include, but are not limited to, bactericides, viricides, fungicides, parasiticides, and the like.

As used herein, the terms "protein biocide" and "protein biocides" refer to at least a portion of a naturally occurring or synthetic peptide molecule or enzyme that directly kills or promotes the death and/or attenuation of (e.g., prevents growth and/or replication) of biological targets (e.g., bacteria, parasites, yeast, viruses, fungi, protozoas and the like). Examples of biocides include, but are not limited to, bactericides, viricides, fungicides, parasiticides, and the like.

As used herein, the term "neutralization," "pathogen neutralization," "and spoilage organism neutralization" refer to destruction or inactivation (e.g., loss of virulence) of a "pathogen" or "spoilage organism" (e.g., bacterium, parasite, virus, fungus, mold, prion, and the like) thus preventing the pathogen's or spoilage organism's ability to initiate a disease state in a subject or cause degradation of a food product.

As used herein, the term "spoilage organism" refers to microorganisms (e.g., bacteria or fungi), which cause degradation of the nutritional or organoleptic quality of food and reduces its economic value and shelf life. Exemplary food spoilage microorganisms include, but are not limited to, *Zygosaccharomyces bailii, Aspergillus niger, Saccharomyces cerivisiae, Lactobacillus plantarum, Streptococcus faecalis*, and *Leuconostoc mesenteroides*.

As used herein, the term "microorganism targeting molecule" refers to any molecule (e.g., protein) that interacts with a microorganism. In preferred embodiments, the microorganism targeting molecule specifically interacts with microorganisms at the exclusion of non-microorganism host cells. Preferred microorganism targeting molecules interact with broad classes of microorganism (e.g., all bacteria or all gram positive or negative bacteria). However, the present invention also contemplates microorganism targeting molecules that interact with a specific species or sub-species of microorganism. In some preferred embodiments, microorganism targeting molecules interact with "Pathogen Associated Molecular Patterns (PAMPS)". In some embodiments, microorganism targeting molecules are recognition molecules that are known to interact with or bind to PAMPS (e.g., including, but not limited to, as CD14, lipopolysaccharide binding protein (LBP), surfactant protein D (SP-D), and Mannan binding lectin (MBL)). In other embodiments, microorganism targeting molecules are antibodies (e.g., monoclonal antibodies directed towards PAMPS or monoclonal antibodies directed to specific organisms or serotype specific epitopes).

As used herein the term "biofilm" refers to an aggregation of microorganisms (e.g., bacteria) surrounded by an extracellular matrix or slime adherent on a surface in vivo or ex vivo, wherein the microorganisms adopt altered metabolic states.

As used herein, the term "host cell" refers to any eukaryotic cell (e.g., mammalian cells, avian cells, amphibian cells, plant cells, fish cells, insect cells, yeast cells), and bacteria cells, and the like, whether located in vitro or in vivo (e.g., in a transgenic organism).

As used herein, the term "cell culture" refers to any in vitro culture of cells. Included within this term are continuous cell lines (e.g., with an immortal phenotype), primary cell cultures, finite cell lines (e.g., non-transformed cells), and any other cell population maintained in vitro, including oocytes and embryos.

The term "isolated" when used in relation to a nucleic acid, as in "an isolated oligonucleotide" refers to a nucleic acid sequence that is identified and separated from at least one contaminant nucleic acid with which it is ordinarily associated in its natural source. Isolated nucleic acids are nucleic acids present in a form or setting that is different from that in which they are found in nature. In contrast, non-isolated nucleic acids are nucleic acids such as DNA and RNA that are found in the state in which they exist in nature.

The terms "in operable combination," "in operable order," and "operably linked" as used herein refer to the linkage of nucleic acid sequences in such a manner that a nucleic acid molecule capable of directing the transcription of a given gene and/or the synthesis of a desired protein molecule is produced. The term also refers to the linkage of amino acid sequences in such a manner so that a functional protein is produced.

A "subject" is an animal such as vertebrate, preferably a mammal such as a human, a bird, or a fish. Mammals are understood to include, but are not limited to, murines, simians, humans, bovines, cervids, equines, porcines, canines, felines etc).

An "effective amount" is an amount sufficient to effect beneficial or desired results. An effective amount can be administered in one or more administrations, As used herein, the term "purified" or "to purify" refers to the removal of undesired components from a sample. As used herein, the term "substantially purified" refers to molecules, either nucleic or amino acid sequences, that are removed from their natural environment, isolated or separated, and are at least 60% free, preferably 75% free, and most preferably 90% free from other components with which they are naturally associated. An "isolated polynucleotide" is therefore a substantially purified polynucleotide.

The terms "bacteria" and "bacterium" refer to prokaryotic organisms, including those within all of the phyla in the Kingdom Procaryotae. It is intended that the term encompass all microorganisms considered to be bacteria including *Mycoplasma, Chlamydia, Actinomyces, Streptomyces*, and *Rickettsia*. All forms of bacteria are included within this definition including cocci, bacilli, spirochetes, spheroplasts, protoplasts, etc. Also included within this term are prokaryotic organisms that are gram negative or gram positive. "Gram negative" and "gram positive" refer to staining patterns with the Gram-staining process that is well known in the art. (See e.g., Finegold and Martin, Diagnostic Microbiology, 6th Ed., CV Mosby St. Louis, pp. 13-15 [1982]). "Gram positive bacteria" are bacteria that retain the primary dye used in the Gram stain, causing the stained cells to appear dark blue to purple under the microscope. "Gram negative bacteria" do not retain the primary dye used in the Gram stain, but are stained by the counterstain. Thus, gram negative bacteria appear red. In some embodiments, the bacteria are those capable of causing disease (pathogens) and those that cause product degradation or spoilage.

"Strain" as used herein in reference to a microorganism describes an isolate of a microorganism (e.g., bacteria, virus, fungus, parasite) considered to be of the same species but with a unique genome and, if nucleotide changes are non-synonymous, a unique proteome differing from other strains of the same organism. Typically strains may be the result of isolation from a different host or at a different location and time but multiple strains of the same organism may be isolated from the same host.

DETAILED DESCRIPTION OF THE INVENTION

This invention relates to the identification of peptide epitopes from proteomes of microorganisms and host cells as a result of infection or perturbation of normal metabolism or tumorigenesis. Peptide epitopes may also be identified in mammalian cells wherein said peptides lead to autoimmune responses. Once peptide epitopes are identified, they can be synthesized or produced as recombinant products (e.g., the epitope itself or a polypeptide or protein comprising the epitope) and utilized in vaccines, diagnostics or as targets of drug therapy. The accurate prediction of peptides which are epitopes for either B-cell or T-cell mediated immunity is thus an important step in providing, among other things: understanding of how the proteome is presented to, and processed by, the immune system; information enabling development of improved vaccines, diagnostics, and antimicrobial drugs; and methods of identifying targets on membrane proteins potentially useful to other areas of research Proteome information is now available for many organisms and the list of available proteomes is increasing daily. The challenge is how to analyze the proteome to provide understanding and guidance on how the proteome, and especially the surface proteome (surfome) interacts with the immune system through B-cell and T-cell epitopes. This can provide practical tools for construction of vaccines, passive antibody therapies, epitope targeting of drugs, and a better understanding of how epitopes act together to initiate and maintain an adaptive immune response. Identification of changes in epitope patterns may also permit epidemiologic tracking of microbial change.

Much of the understanding of the epitopes comes from vaccinology. Vaccines fall into three general groups. The first two originated with Jenner and Pasteur and depend on whole attenuated or inactivated organisms. Many vaccines in use today are still products of these approaches. More recently, subunit vaccines have been developed with mixed success (Zahradnik et al. 1987. J. Infect. Dis. 155:903-908). In some cases subunits have failed due to over simplification or lack of recognition of intraspecies diversity (Muzzi et al. Drug Discov. Today 12:429-439, 2007; Subbarao et al. 2003. Virology 305:192-200). There are as yet very few vaccines approved which are the product of genetic engineering (exceptions are detoxification of pertussis and modification of the influenza hemagluttinin cleavage site (Pizza et al. 2003. Methods Mol. Med. 87:133-152). As new vehicles for peptide delivery (VLPs, Lactococcus, etc.) have become available, our ability to display arrays of peptide epitopes to the immune system has increased. (Buccato et al. 2006. J. Infect. Dis. 194:331-340; Jennings, G. T. and M. F. Bachmann. 2008. Biol. Chem. 389:521-536).

The goal of vaccination is to induce a long term immunological memory. Most successful vaccines target surface exposed B-cell epitopes. In many cases antibodies to bacteria and to viruses are indeed protective, and antibodies have long been an index of vaccinal efficacy (Rappuoli 2007. Nat. Biotechnol. 25:1361-1366). Regulatory authorities rely on antibody response as a criterion for approval where challenge experiments would be infeasible or unethical. Less attention has been placed on T-cell responses, which are harder to evaluate (De Groot 2006. Drug Discov. Today 11:203-209). Both B and T-cell responses are needed for the most robust response and long term T-cell memory provides protection that is essential for some pathogens, especially for chronic diseases or those caused by intracellular organisms (Kaufmann 2007. Nat. Rev. Microbiol. 5:491-504; Rappuoli 2007. Nat. Biotechnol. 25:1361-1366; Zanetti and Franchini. 2006. Trends Immunol. 27:511-517). A recent meta-analysis of reports of Plasmodium epitopes identified a surprising 14% epitopes had been reported as both T and B-cell epitopes (Vaughan et al. 2009. Parasite Immunol. 31:78-97). Only one report has shown specific pairing of B and T-cell epitopes within a single protein, in the response to vaccinia (Sette et al. 2008. Immunity. 28:847-858).

Diagnostic tests for both infectious and non infectious diseases depend heavily on epitope binding reactions to identify diseased cells, infectious agents and antibody responses to epitopes. Monoclonal antibodies have played a huge role in the evolution of diagnostics over the last 30 years. The ability to analyze peptide epitopes on microorganisms to determine which are conserved within genus or family and which are species or strain specific will greatly aid design of diagnostic tests. The ability to define peptide epitopes based on genome and proteome information and then synthesize them creates the potential to make diagnostic tests to study organisms which have not been cultured in vitro, potentially of great importance for a newly emerging disease.

Definition of epitopes on the surface of organisms or cells (such as tumor cells) also offers the opportunity to develop antibodies which bind to such epitopes. In some cases such antibodies are neutralizing either through steric hindrance or through the recruitment of complement or by providing a greater degree of recognition through enhanced dendritic cell uptake. In other cases recombinant antibodies can be constructed which deliver secondary reagents as fusion partners, whether these are antimicrobial peptides (biocides) acting on microorganisms or fusion antibodies used to deliver active pharmaceutical components to cancer cells. The ability to define surface epitopes thus offers the ability to design therapeutic drugs which target the underlying organism or cell.

B-cell epitopes may be linear peptide sequences of varying length or may depend on three dimensional topology comprising multiple short peptide sequences. In contrast, T-cell epitopes lie within short linear peptide sequences (e.g., 8-mers or 9-mers up to 15-mers with or without a few N- or C-terminal flanking residues which are bound by the MHC receptor after proteasomal processing (Janeway 2001. Immunobiology. Garland Publishing). T-cell epitopes have multiple roles in vaccination controlling the outcome of both antibody mediated and cell-mediated responses (Kaufmann 2007).

The distinction between organisms which stimulate MHC-II and those which stimulate MHC-I is now seen as less clear-cut than once thought (Kaufmann 2007). T-cell epitope prediction has been applied to Mycobacterium tuberculosis by McMurray et al. (McMurray et al 2005. Tuberculosis (Edinb.) 85:95-105). Moutaftsi (Moutaftsti et al. 2006. Nat. Biotechnol. 24:817-819), demonstrated that, in the case of vaccinia virus, bioinformatics predictive programs accurately identified the MHC-I restricted T-cell epitope peptides, as validated in vivo. While only 49 peptides (of a total 2258 predicted epitopes) accounted for 95% of the T-cell response, the number of antigens to which there is some T-cell response was far broader than expected, indicating the concept of immunodominance may be over simplification. Sette et al, in following on to this work, showed that vaccinia MHC-II restricted epitopes were partnered specifically to B-cell epitopes located on the same protein (Sette, A. et al. 2008. Immunity. 28:847-858). This appears to be the first report of specific pairing of T- and B-cell epitopes at a protein level and challenges the concept that any T-cell epitope can provide a complementary stimulus, irrespective of its location. However, unlike the present invention, this reference does not identify linkage of B and T-cell epitopes at a peptide level. Lanzaveccia demonstrated that B and T-cell interaction is antigen specific (Lanzavecchia A. 1985 Nature 314: 537-539 and proposed mechanisms for T/B-cell cooperation.

The ideal vaccine, in addition to providing protection and long term memory, would have broadly conserved antigen(s) and be highly immunogenic (Kauffman, 2007). As the proteome for multiple strains of bacteria has been resolved, it is seen that for some bacteria inter-strain diversity may equal interspecies diversity (Muzzi 2007. Drug Discov. Today 12:429-439). Core genes found in all strains appear desirable for vaccination, however, they may also be mostly immunologically silent hence evading selection pressure (Maione et al., 2005; Muzzi et al., 2007).

The field of bioinformatics has provided powerful tools to analyze large datasets arising from sequenced genomes, proteomes and transcriptomes. But often analysis of the proteomic information has been based on individual amino acids, using sequences, not segments, and without translation to structure, biological function and location of the proteins in the whole organism. The leading proponents of reverse vaccinology identify the challenge of the future as the integration of sequence-based prediction with structural information (Serruto and Rappuoli. 2006. FEBS Lett. 580: 2985-2992.)

The availability of large amounts of proteomic information spawned the development of a large number of applications for analysis of the information. The main repository of genomic information is NCBI and a number of NCBI programs are available on line or downloadable. In addition, there are many other private and publicly managed websites (e.g., patricbrc.org). One of the more comprehensive and widely used sites for prokaryotic information (e.g., psort.org) has produced an extensive catalog and links to sites for prediction of prokaryotic subcellular location (23 websites), eukaryotic predictors (38 websites), nuclear and viral predictors (9 websites), subcellular location databases (21 websites), transmembrane alpha helix predictors (22 websites) and beta barrel outer membrane predictors (8 websites). Unfortunately, the output formats vary widely, some have adopted their own nomenclature, and outputs from several cannot be readily consolidated in meaningful ways. The psort website provides a comprehensive database of prokaryotic information with some summarization, but analysis of an entire proteome is cumbersome. Their approach to proteins with transmembrane helices is limited and outdated. The Immune Epitope Database (Zhang et al. 2008. Nucleic Acids Res. 36:W513-W518.) provides a registry of all current known epitope sequences. However it arrays these as single entities and does not enable linkage of interactive epitopes.

For the reasons stated above there is a need for a method to identify peptide epitopes for both B and T-cell immunity which can enhance the development of vaccines, therapeutics and vaccines. The present invention provides methods of B-cell epitope prediction and MHC binding region prediction, together with the topological/protein structural considerations. It also provides an integrated approach and enables the management of peptide epitope analysis from a desktop computer in a familiar spreadsheet format.

Accordingly, in some embodiments, the present invention provides computer implemented processes of identifying peptides that interact with a partner or substrate, e.g., other polypeptides, including but not limited to, B-cell receptors and antibodies, MHC-I and II binding regions, protein receptors, polypeptide domains such as binding domains and catalytic domains, organic molecules, aptamers, nucleic acids and the like. In some embodiments, the present invention provides computer implemented processes of identifying peptides that interact with a partner or substrate that formulate a mathematical expression that correlates to or describes one or more physical properties of amino acid within an amino acid subset and applies the mathematical expression to predict the interaction (e.g., binding) of the amino acids subset with the partner. In some embodiments, the present invention provides computer implemented processes of identifying peptides that interact with a partner or substrate that formulate a mathematical expression that correlates to or describes one or more physical properties of amino acids within an amino acid subset, substitutes the amino acids with the mathematical expression, and applies the mathematical expression to predict the interaction (e.g., binding) of the amino acid subset with the partner. In some embodiments, the present invention provides computer implemented processes of identifying peptides that interact with a partner or substrate that formulate a mathematical expression based on the principal components of physical properties of amino acids within an amino acid subset and applies the mathematical expression to predict the interaction (e.g., binding) of the amino acids subset with the partner. In some embodiments, the present invention provides computer implemented processes of identifying peptides that interact with a partner or substrate that formulate a mathematical expression based on the principal components of physical properties of amino acids within an amino acid subset and applies the mathematical expression to predict the interaction (e.g., binding) of the amino acids subset with the partner. In some embodiments, the present invention provides computer implemented processes of identifying peptides that interact with a partner or substrate that formulate a mathematical expression based on the principal components of physical properties of amino acids within an amino acid subset and applies the mathematical expression to predict the interaction (e.g., binding) of the amino acids subset with the partner using a trained neural network. In some embodiments, the present invention provides computer implemented processes of identifying peptides that interact with MHC binding region, B cell receptor, or antibody that formulate a mathematical expression based on the principal components of physical properties of amino acids within an amino acid subset and applies the mathematical expression to predict the interaction (e.g., binding) of the amino acids subset with the partner using a trained neural network, for example a neural network trained for peptide binding to one more MHC alleles or binding regions.

In some embodiments, the present invention a computer implemented process comprising: in-putting an amino acid sequence from a target source into a computer; analyzing more than one physical parameter of subsets of amino acids in the sequence via a computer processor; deriving a mathematical expression to describe amino acid subsets; applying the mathematical expression to predict the ability of amino acid subsets to bind to a binding partner; and outputting sequences for the amino acid subsets identified as having an affinity for a binding partner.

In some preferred embodiments, the methods are used to predict MHC binding affinity using a neural network prediction scheme based on amino acid physical property principal components. Briefly, for MHC-II a protein is broken down into 15-mer peptides each offset by 1 amino acid. The peptide 15-mers are converted into vectors of principal components wherein each amino acid in a 15-mer is replaced by three z-scale descriptors. {z1(aa1),z2(aa1),z3(aa1)}, {z1(aa2),z2(aa2),z3(aa2)}, {z1(aa15),z2(aa15),z3(aa15)} that are effectively physical property proxy variables. With these descriptors ensembles of neural network prediction equation sets are developed, using publicly available datasets of peptide-MHC binding data, wherein the inhibitory concentration 50% ($ic_{50}$) has been catalogued as a measure of binding affinity of the peptides for a number of different HLAs. Because the $ic_{50}$ data have a numerical range in excess of 10,000-fold they are natural logarithm transformed to give the data better distributional properties for predictions and subsequent statistical analysis used the $\ln(ic_{50})$. For each of the 15-mers predicted $\ln(ic_{50})$ values are computed for fourteen different human MHC-II alleles DRB1*0101, DRB1*0301, DRB1*0401, DRB1*0404, DRB1*0405, DRB1*0701, DRB1*0802, DRB1*0901, DRB1*1101, DRB1*1302, DRB1*1501, DRB3*0101, DRB4*0101, DRB5*0101. The peptide data is indexed to the N-terminal amino acid and thus each prediction corresponds to the 15-amino acid peptide downstream from the index position. See, e.g., An integrated approach to epitope analysis I: Dimensional reduction, visualization and prediction of MHC binding using amino acid principal components and regression approaches. Bremel R D, Homan E J. Immunome Res. 2010 Nov. 2; 6:7; An integrated approach to epitope analysis II: A system for proteomic-scale prediction of immunological characteristics. Bremel R D, Homan E J. Immunome Res. 2010 Nov. 2; 6:8.

An identical process is then followed with all 9-mer peptides for prediction of binding to 35 MHC-I alleles: A*0101, A*0201, A*0202, A*0203, A*0206, A*0301, A*1101, A*2301, A*2402, A*2403, A*2601, A*2902, A*3001, A*3002, A*3101, A*3301, A*6801, A*6802, A*6901, B*0702, B*0801, B*1501, B*1801, B*2705, B*3501, B*4001, B*4002, B*4402, B*4403, B*4501, B*5101, B*5301, B*5401, B*5701, B*5801. Each of the alleles has a different characteristic mean and standard deviation of binding affinity. Thus, for statistical comparisons involving multiple HLA alleles the predicted $\ln(ic_{50})$ values are standardized to zero mean and unit standard deviation on a within-protein basis.

The methodology elaborated herein enables the description of binding of an amino acid subset or peptide derived from a protein to a binding partner, based on the use of principal components as proxies for the salient physical parameters of the peptide. Having used the principal components to reduce the dimensionality of the descriptors to a mathematical expression it is then possible to analyze the binding interface of the peptide statistically. In applications described herein, this technology is applied to understanding the binding to binding partners derived from the humoral and cellular immune system (B cell receptors or antibodies and MHC molecules which present peptides to T-cell epitopes). This however should not be considered limiting and the methodology may also be applied to other peptide binding and recognition events. Examples of such events include but are not limited to enzyme recognition of peptides, receptor binding of peptides (including but not limited to sensory receptors such as olfactory or taste receptors, receptors which bind to protein hormones, viral receptors on cell surfaces etc). Indeed the approach of using principal components to describe a peptide interface with a binding partner is applicable whether said binding partner is another protein or a lipid, carbohydrate or other substrate. In one particular embodiment the method of principal component analysis was applied to identify protease cut sites in a target protein. These and other embodiments are described in more detail below.

A. Identification of Epitopes

The immune system has the capability of responding to a multitude of foreign antigens, producing specific responses with a long term memory for each specific antigen that evokes a response. When a self antigen elicits a response an autoimmune response may occur. Two classes of cells, called T-cells and B-cells, are critically important in this process and each of these has receptors linked to a host of responses in the respective cell type. The classical major histocompatibility (MHC) molecules on antigen presenting cells play a pivotal role in the adaptive immune response mediated by T-cells. In humans MHC molecules are also known as the human leukocyte antigens (HLA).

A T-cell immune response is induced when a T-cell receptor (TCR) recognizes and binds to MHC molecules on antigen presenting cells, when the MHC molecule has a foreign peptide bound to its binding domain. MHC binding sites are always loaded with peptides which bind competitively such that the peptide with highest binding affinity occupies the binding site. During development, T-cells that recognize self-antigens are deleted so that the population of cells that remains is uniquely equipped to recognize foreign antigens that may derived from infection or tumorigenesis. MHC molecules fall into two major classes: MHC-I capable of binding peptides from 8-10 amino acids; and MHC-II that bind peptides from 9-22 amino acids. Each of these MHC classes interacts with different populations of T-cells in the development of an adaptive immune response depending on whether the foreign antigen has arisen from an intracellular (e.g. virus infection) or intercellular source (e.g. extracellular bacterial infection).

B-cells are a partner to the T-cells in development of an adaptive immune response. B-cells have a different type of receptor (B-cell receptor, BCR) that is a specialized form of an immunoglobulin molecule on their surface. The BCR also binds peptides on foreign antigens called B-cell epitopes (BEPI) but is much less discriminatory with respect to size, and the binding site actually undergoes molecular evolution during the course of development of an immune response. The B-cell and its receptor is thus the second arm of antigen recognition. To elicit a specific, long-lived immune response both T-cells and B-cells must be stimulated (Lanzavecchia A. 1985). However, to prevent non specific responses, such coincident stimulation is necessarily a rare event. An antigen presenting cell that has engulfed and digested a bacteria or other foreign material will potentially present millions of different peptides on its surface. Exactly how the specificity arises has been a long standing mystery.

The proteolytic machinery in an antigen presenting cell will process a microorganism (e.g., a bacteria) into a huge array of peptide fragments of different lengths. To mount a specific immune response these peptides must stimulate both B-cells and T-cells. Taken together the results of these studies suggest the possibility that the coincident stimulation of the two types of cells occurs by some type of simultaneous binding by MHC and BCR. Stimulation attributed to the same protein could occur if an elongated peptide had adjacent binding sites for a MHC receptor and a BCR. It is difficult to envision a mechanism where cells, facing a huge array of peptides bound to receptors, would find a protein match unless the two receptors are binding to the same or immediately adjacent peptides.

It is conceivable that the ineffectiveness of certain vaccine candidates is the result of failure of the selected peptides or proteins to appropriately stimulate both arms of the immune response.

The field of Immunological Bioinformatics (TB) is a research field that applies informatics techniques to generate a systems-level view of the immune system. A major goal of IB has been to improve vaccine development using genomic information. IB has developed many computational (in silico) tools for characterizing sequences with respect to their roles in various aspects of the immune system. Many of these tools, that are computationally intensive, can be accessed over the internet from sites with substantial computing resources (see Table 1 for listing of sites). Most likely because of the computational requirements, most of the available internet-accessible tools do not have the ability to handle more than a small number of sequences and are not capable of proteome level analysis.

ments, use of a coincidence algorithm makes it possible to utilize these processes to predict the pattern of MHC binding of a diverse human population by computing the permuted statistics of binding. These processes make it possible to define and catalog peptides that are conserved across strains of organism and human MHC haplotypes/binding regions. Accordingly, referring to FIG. 1, the present invention provides computer implemented systems and processes for analyzing all or portions of target proteome(s) to identify peptides that are B-cell epitopes and/or bind to one or more MHC binding regions (i.e., peptides that are B-cell and/or T-cell epitopes). The systems and processes comprise a series of mathematical and statistical processes carried out with proteins sequences in a proteome (1) or a set of related proteomes, with the output goal of producing epitope lists (14) which comprise defined amino acid sequences within the proteins of the proteome that have useful immunological characteristics.

A proteome (1) is a database table consisting of all of the proteins that are predicted to be coded for in an organism's genome. A large number of proteomes are publicly available from Genbank in an electronic form that have been "curated" to describe the known or putative physiological function of the particular protein molecule in the organism. Advances in DNA sequencing technology now makes it

TABLE 1

| | |
|---|---|
| General immunology resources | immuneepitope.org/ |
| Amino acid physical properties | expasy.org/tools/protscale.html |
| Training sets | immuneeepitope.org/links/ |
| Web NN & Training sets | cbs.dtu.dk/suppl/immunology/NetMHCII-2.0.php |
| Web NN & training sets | cbs.dtu.dk/services/NetMHC/ |
| Training Sets | bio.dfci.harvard.edu/DFRMLI/ |
| Training Sets | syfpeithi.de/ |
| Philius protein topology predictor | yeastrc.org/philius |
| Phobius protein topology predictor | phobius.binf.ku.dk/ |

The different in silico methods are either qualitative or quantitative in nature and involve different types of peptide sequence pattern modeling and classification (reviewed by Lafuente, E. M. and Reche, P. A., Curr. Pharm. Des 2009. 15: 3209-3220). In practice the prediction of MHC-peptide binding is "far from perfect" (Lafuente 2009) and it has been suggested that in silico predictions with current tools leads to "more confusion than conclusion" (Gowthaman, U. and Agrewala, J. N., J. Proteome. Res. 2008. 7: 154-163). Overall, MHC-binding prediction is vital for epitope definition, but has "ample room for improvement" (Lafuente 2009).

With the advances in genome sequencing it is possible to readily obtain proteomic information from a wide array of strains of infectious organism. Hence conducting rational design of vaccines for infectious organisms requires in silico tools capable of analyzing and providing an organismal-level view of the entire proteomes from many strains of the same organism.

In some embodiments, the present invention provides processes that make it possible to analyze proteomic-scale information on a personal computer, using commercially available statistical software and database tools in combination with several unique computational procedures. The present invention improves computational efficiency by utilizing amino acid principal components as proxies for physical properties of the amino acids, rather than a traditional alphabetic substitution matrix bioinformatics approach. This has allowed new, more accurate and more efficient procedures for epitope definition to be realized. In further embodipossible to sequence an entire organism's genome in a day and will greatly expand the availability of proteomic information. Having many strains of the same organism available for analysis will improve the potential for defining epitopes universally. However, the masses of data available will also require that tools such as those described in this specification be made available to a scientist without the limitations of those resources currently available over the internet.

Proteins are uniquely identified in genetic databases. The Genbank administrators assign a unique identifier to the genome (GENOME) of each organism strain. Likewise a unique identifier called the Gene Index (GI) is assigned to each gene and cognate protein in the genome. As the GENOME and GI are designed to be unique identifiers they are used in this specification in all database tables and to track the proteins as the various operations are carried out. By convention the amino acid sequences of proteins are written from N-terminus (left) to C-terminus (right) corresponding to the translation of the genetic code. A 1-based numbering system is used where the amino acid at the N-terminus is designated number 1, counting from the signal peptide methionine. At various points in the process it is necessary to unambiguously identify the location of a certain amino acid or groups of amino acids. For this purpose, a four component addressing system has been adopted that has the four elements separated by dots (Genome. GI. N. C).

Figure 1:
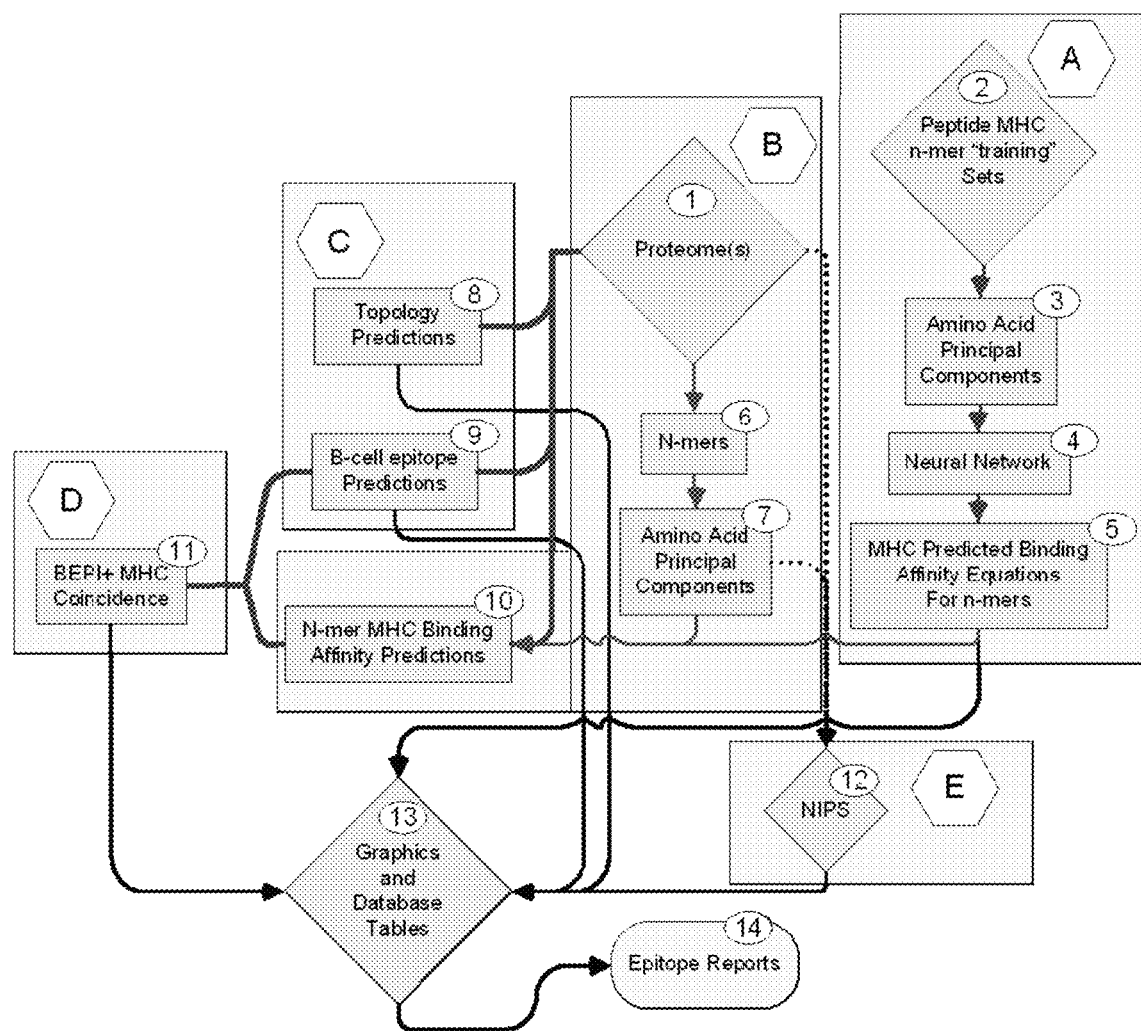
FIG. 1A-E is a flow chart of the elements of the peptide epitope prediction process.

Referring to FIG. 1, in some embodiments, a Proteome (1) of interest is obtained in "FASTA" format via FTP transfer from the Genbank website. This format is widely used and consists of a single line identifier beginning with a single ">"

and contains the GENOME and GI plus the protein's curation and other relevant organismal information followed by the protein sequence itself. In addition to the FASTA formatted file a database table is created that contains all of the information.

In some embodiments, principal components of amino acids are utilized to accurately predict binding affinities of sub-sequences of amino acids within the proteins to all MHC-I and MHC-II receptors. Principal Components Analysis is a mathematical process that is used in many different scientific fields and which reduces the dimensionality of a set of data. (Bishop, C. M., Neural Networks for Pattern Recognition. Oxford University Press, Oxford 1995. Bouland, H. and Kamp, Y., Biological Cybernetics 1988. 59: 291-294). Derivation of principal components is a linear transformation that locates directions of maximum variance in the original input data, and rotates the data along these axes. Typically, the first several principal components contain the most information. Principal components is particularly useful for large datasets with many different variables. Using principal components provides a way to picture the structure of the data as completely as possible by using as few variables as possible. For n original variables, n principal components are formed as follows: The first principal component is the linear combination of the standardized original variables that has the greatest possible variance. Each subsequent principal component is the linear combination of the standardized original variables that has the greatest possible variance and is uncorrelated with all previously defined components. Further, the principal components are scale-independent in that they can be developed from different types of measurements. For example, datasets from HPLC retention times (time units) or atomic radii (cubic angstroms) can be consolidated to produce principal components. Another characteristic is that principal components are weighted appropriately for their respective contributions to the response and one common use of principal components is to develop appropriate weightings for regression parameters in multivariate regression analysis. Outside the field of immunology, principal components analysis (PCA) is most widely used in regression analysis. Initial tests were conducted using the principal components in a multiple regression partial least squares (PLS) approach (Wold, S., Sjorstrom, M., and Eriksson, L., Chemometrics and Intelligent Laboratory Systems 2001. 58: 109-130). Principal component analysis can be represented in a linear network. PCA can often extract a very small number of components from quite high-dimensional original data and still retain the important structure.

Over the past half century a wide array studies of physicochemical properties of amino acids have been made for applications outside immunogenetics. Others have made tabulations of principal components, for example in the paper Wold et al (Wold 2001) that describes the mathematical theory underlying the use of principal components in partial least squares regression analysis. The work of Wold et al uses eight physical properties.

Accordingly, in some embodiments, physical properties of amino acids are used for subsequent analysis. In some embodiments, the compiled physical properties are available at a proteomics resource website (expasy.org/tools/protscale.html). In some embodiments, the physical properties comprise one or more physical properties derived from the 31 different studies as shown in Table 2. In some embodiments, the data for each of the 20 different amino acids from these studies are tabulated, resulting in 20×31 different datapoints, each providing a unique estimate of a physical characteristic of that amino acid. The power of principal component analysis lies in the fact that the results of all of these studies can be combined to produce a set of mathematical properties of the amino acids which have been derived by a wide array of independent methodologies. The patterns derived in this way are similar to those of Wold et. al. but the absolute numbers are different. The physicochemical properties derived in the studies used for this calculation are shown in (Table 2). FIG. 2 shows eigen values for the 19-dimensional space describing the principal components, and further shows that the first three principal component vectors account for approximately 89.2% of the total variation of all physicochemical measurements in all of the studies in the dataset. All subsequent work described herein is based on use of the first three principal components.

TABLE 2

| | | |
|---|---|---|
| 1 | Polarity. | Zimmerman, J. M., Eliezer, N., and Simha, R., J. Theor. Biol. 1968. 21: 170-201. |
| 2 | Polarity (p). | Grantham, R., Science 1974. 185: 862-864. |
| 3 | Optimized matching hydrophobicity (OMH). | Sweet, R. M. and Eisenberg, D., J. Mol. Biol. 1983. 171: 479-488. |
| 4 | Hydropathicity. | Kyte, J. and Doolittle, R. F.,. J. Mol. Biol. 1982. 157: 105-132. |
| 5 | Hydrophobicity (free energy of transfer to surface in kcal/mole). | Bull, H. B. and Breese, K., Arch. Biochem. Biophys. 1974. 161: 665-670. |
| 6 | Hydrophobicity scale based on free energy of transfer (kcal/mole). | Guy, H. R., Biophys. J. 1985. 47: 61-70. |
| 7 | Hydrophobicity (delta G1/2 cal) | Abraham, D. J. and Leo, A. J., Proteins 1987. 2: 130-152. |
| 8 | Hydrophobicity scale (contact energy derived from 3D data). | Miyazawa, S. and Jernigan, R. L., Macromolecules 1985. 18: 534-552. |
| 9 | Hydrophobicity scale (pi-r). | Roseman, M. A., J. Mol. Biol. 1988. 200: 513-522. |
| 10 | Molar fraction (%) of 2001 buried residues. | Janin, J., Nature 1979. 277: 491-492. |
| 11 | Proportion of residues 95% buried (in 12 proteins). | Chothia, C., J. Mol. Biol. 1976. 105: 1-12. |
| 12 | Free energy of transfer from inside to outside of a globular protein. | Janin, J., Nature 1979. 277: 491-492. |
| 13 | Hydration potential (kcal/mole) at 25øC. | Wolfenden, R., Andersson, L., Cullis, P. M., and Southgate, C. C., Biochemistry 1981. 20: 849-855. |

TABLE 2-continued

| | | |
|---|---|---|
| 14 | Membrane buried helix parameter. | Rao, M. J. K. and Argos, P., Biochim. Biophys. Acta 1986. 869: 197-214. |
| 15 | Mean fractional area loss (f) [average area buried/standard state area]. | Rose, G. D., Geselowitz, A. R., Lesser, G. J., Lee, R. H., and Zehfus, M. H., Science 1985. 229: 834-838. |
| 16 | Average area buried on transfer from standard state to folded protein. | Rose, G. D., Geselowitz, A. R., Lesser, G. J., Lee, R. H., and Zehfus, M. H., Science 1985. 229: 834-838. |
| 17 | Molar fraction (%) of 3220 accessible residues. | Janin, J., Nature 1979. 277: 491-492. |
| 18 | Hydrophilicity. | Hopp, T. P., Methods Enzymol. 1989. 178: 571-585. |
| 19 | Normalized consensus hydrophobicity scale. | Eisenberg, D., Schwarz, E., Komaromy, M., and Wall, R., J. Mol. Biol. 1984. 179: 125-142. |
| 20 | Average surrounding hydrophobicity. | Manavalan, P. and Ponnuswamy, P. K., Nature 1978. 275: 673-674. |
| 21 | Hydrophobicity of physiological L-alpha amino acids | Black, S. D. and Mould, D. R., Anal. Biochem. 1991. 193: 72-82 |
| 22 | Hydrophobicity scale (pi-r)2. | Fauchere, J. L., Charton, M., Kier, L. B., Verloop, A., and Pliska, V., Int. J. Pept. Protein Res. 1988. 32: 269-278. |
| 23 | Retention coefficient in HFBA. | Browne, C. A., Bennett, H. P., and Solomon, S., Anal. Biochem. 1982. 124: 201-208. |
| 24 | Retention coefficient in HPLC, pH 2.1. | Meek, J. L., Proc. Natl. Acad. Sci. U.S.A 1980. 77: 1632-1636. |
| 25 | Hydrophilicity scale derived from HPLC peptide retention times. | Parker, J. M., Guo, D., and Hodges, R. S., Biochemistry 1986. 25: 5425-5432. |
| 26 | Hydrophobicity indices at ph 7.5 determined by HPLC. | Cowan, R. and Whittaker, R. G., Pept. Res. 1990. 3: 75-80. |
| 27 | Retention coefficient in TFA | Browne, C. A., Bennett, H. P., and Solomon, S., Anal. Biochem. 1982. 124: 201-208. |
| 28 | Retention coefficient in HPLC, pH 7.4 | Meek, J. L., Proc. Natl. Acad. Sci. U.S.A 1980. 77: 1632-1636. |
| 29 | Hydrophobicity indices at pH 3.4 determined by HPLC | Cowan, R. and Whittaker, R. G., Pept. Res. 1990. 3: 75-80. |
| 30 | Mobilities of amino acids on chromatography paper (RF) | Akintola, A. and Aboderin, A. A., Int. J. Biochem. 1971. 2: 537-544. |
| 31 | Hydrophobic constants derived from HPLC peptide retention times | Wilson, K. J., Honegger, A., Stotzel, R. P., and Hughes, G. J., Biochem. J. 1981. 199: 31-41. |

In some embodiments, principal component vectors derived are shown in Table 3. Each of the first three principal components is sorted to demonstrate the underlying physicochemical properties most closely associated with it. From this it can be seen that the first principal component (Prin1) is an index of amino acid polarity or hydrophobicity; the most hydrophobic amino acids have the highest numerical value. The second principal component (Prin2) is related to the size or volume of the amino acid, with the smallest having the highest score. The physicochemical properties embodied in the third component (Prin3) are not immediately obvious, except for the fact that the two amino acids containing sulfur rank among the three smallest magnitude values.

TABLE 3

| Amino acid | Prin1 | Amino Acid | Prin2 | Amino Acid | Prin3 |
|---|---|---|---|---|---|
| K | -6.68 | W | -3.50 | C | -3.84 |
| R | -6.30 | R | -2.93 | H | -1.94 |
| D | -6.04 | Y | -2.06 | M | -1.46 |
| E | -5.70 | F | -1.53 | E | -1.46 |
| N | -4.35 | K | -1.32 | R | -0.91 |
| Q | -3.97 | H | -1.00 | V | -0.35 |
| S | -2.65 | Q | -0.47 | D | -0.18 |
| H | -2.55 | M | -0.43 | I | 0.04 |
| T | -1.42 | P | -0.36 | F | 0.05 |
| G | -0.76 | L | -0.20 | Q | 0.15 |
| P | -0.03 | D | 0.03 | W | 0.16 |
| A | 0.72 | N | 0.21 | N | 0.30 |
| C | 2.11 | I | 0.29 | Y | 0.37 |
| Y | 2.58 | E | 0.34 | T | 0.94 |
| M | 4.14 | T | 0.80 | K | 1.16 |
| V | 4.79 | S | 1.84 | L | 1.17 |
| W | 5.68 | V | 1.98 | G | 1.21 |
| L | 6.59 | A | 2.48 | S | 1.30 |
| I | 6.65 | C | 2.74 | A | 1.42 |
| F | 7.18 | G | 3.08 | P | 1.87 |

In some embodiments, the systems and processes of the present invention use from about one to about 10 or more vectors corresponding to a principal component. In some embodiments, for example, either one or three vectors are created for the amino acid sequence of the protein or peptide subsequence within the protein. The vectors represent the mathematical properties of the amino acid sequence and are created by replacing the alphabetic coding for the amino acid with the relevant mathematical properties embodied in each of the three principal components.

Process "A": Derivation of Techniques for Determination of MHC Binding Affinity

Partial Least Squares Regression. Having derived the amino acid principal components as described above, Process "A" (referring to FIG. 1) was arrived at through a series of tests and experiments, to provide a means to derive the MHC binding affinity of microbial peptides. In some embodiments, peptide training sets (Step 2) consisting of peptides of 9 amino acids in length (MHC-I) or 15 amino acids in length (MHC-II) were obtained) whose binding affinity for various MHC alleles has been determined experimentally and are available on several immunology and immuno-bioinformatics resource websites (Table 1). These are widely used as benchmarks for different in silico processes. In some embodiments, the letter for each amino acid in the peptide is changed to a three number representation, which is derived from principal components analysis of amino acid physical properties (Step 3) as described above. In some embodiments, the three principal components can thus be considered appropriately weighted and ranked proxies for the physical properties themselves. Wold et. al. (2001, 1988) showed that principal components could be used in partial least squares regression to make predictions about peptides. In some embodiments, the accuracy of partial least squares regression (PLSR) of the principal components at predicting binding affinity is tested. In some embodiments, PLSR produced a series of equations that predicted affinities with reasonable accuracy. In some embodiments, this comparison utilizes a Receiver Operating Characteristic curve (ROC) (Tian et al., Protein Pept. Lett. 2008. 15: 1033-1043) and particularly the area under the ROC (AROC), the metric commonly used in benchmark evaluation in the field of bioinformatics (and machine learning in general) was used.

A ROC summarizes the performance of a two-class classifier across the range of possible thresholds. It plots the sensitivity (class two true positives) versus one minus the specificity (class one false negatives). An ideal classifier hugs the left side and top side of the graph, and the area under the curve is 1.0. A random classifier should achieve approximately 0.5. In machine learning schemes the ROC curve is the recommended method for comparing classifiers. It does not merely summarize performance at a single arbitrarily selected decision threshold, but across all possible decision thresholds. The ROC curve can be used to select an optimum decision threshold. This threshold (which equalizes the probability of misclassification of either class; i.e. the probability of false-positives and false-negatives) can be used to automatically set confidence thresholds in classification networks with a nominal output variable with the two-state conversion function.

A value of 0.5 is equivalent to random chance and a value of 1 is a perfect prediction capability. Using PLSR, the average area under the curve for the fit of 14 different MHC-II alleles was 0.57 and quite similar to NetMHCIIpan, which is one of the classifiers accessible on a immuno-informatics internet site that provide MHC-II prediction services (Table 1 and Table 4). While the score was significantly different from random prediction performance, the difference was small. Unlike PLSR, the NetMHCIIpan predictions are based on a standard bioinformatics approach using alphabetic substitution matrices in an artificial neural network (NN). As can be seen in Table 4, PLSR performed significantly less well than NetMHC_II, which is also a neural network based approach available at the same immuno-informatics website. The differences between the two NN predictors available over the internet, that nominally make the same predictions, are very large but clearly both are better than PLSR. Although our attempts with PLSR was somewhat successful, further testing suggested that underlying non-linearities in the relationship between the amino acid physical properties and binding affinity might be important to consider. The true power and advantage of neural networks lies in their ability to represent both linear and non-linear relationships and in their ability to learn these relationships directly from the data being modeled. Traditional linear models such as PLSR are simply inadequate when it comes to modeling data that contains non-linear characteristics. In fact, the widely-used statistical analysis package SAS treats neural networks simply as another type of regression analysis.

TABLE 4

Comparison between partial least squares regression (PLS) and PrinC MHC_II-NN based on amino acid principal components with several other NN based on based on more traditional amino acid substitution matrices. The metrics uses is the area under the receiver operator characteristic (ROC) curve. The AUC is calculated using a binding affinity threshold of 500 nM. All paired comparisons of means are statistically different Prob > |t| < 0.0001.

| MHC II Allele | PrinC MHC_II -NN | NetMHC_II | NetMHCII Pan | PLS |
|---|---|---|---|---|
| DRB1_0101 | 0.6451 | 0.6907 | 0.6466 | 0.5789 |
| DRB1_0301 | 0.9544 | 0.8823 | 0.6019 | 0.6099 |
| DRB1_0401 | 0.9556 | 0.8445 | 0.631 | 0.5374 |
| DRB1_0404 | 0.9608 | 0.8449 | 0.6301 | 0.5587 |
| DRB1_0405 | 0.9663 | 0.8463 | 0.5883 | 0.5773 |
| DRB1_0701 | 0.9579 | 0.8929 | 0.7162 | 0.6119 |
| DRB1_0802 | 0.9797 | 0.8804 | 0.5495 | 0.602 |
| DRB1_0901 | 0.9606 | 0.8988 | 0.5763 | 0.5322 |
| DRB1_1101 | 0.957 | 0.8934 | 0.5936 | 0.5649 |
| DRB1_1302 | 0.8303 | 0.8368 | 0.5794 | 0.5212 |
| DRB1_1501 | 0.9602 | 0.7945 | 0.5436 | 0.5521 |
| DRB3_0101 | 0.9323 | 0.8721 | 0.6127 | 0.5101 |
| DRB4_0101 | 0.9659 | 0.9417 | 0.6205 | 0.6668 |
| DRB5_0101 | 0.9576 | 0.8841 | 0.6494 | 0.6072 |
| Average | 0.9274 | 0.8574 | 0.6099 | 0.5736 |

Artificial Neural Network Regression. In some embodiments, the present invention provides and utilizes neural networks that predict peptide binding to MHC or HLA binding regions or alleles. A neural network is a powerful data modeling tool that is able to capture and represent complex input/output relationships. The motivation for the development of neural network technology stemmed from the desire to develop an artificial system that could perform "intelligent" tasks similar to those performed by the human brain. Neural networks resemble the human brain in the following two ways: a neural network acquires knowledge through learning and a neural network's knowledge is stored within inter-neuron connection strengths known as synaptic weights (i.e. equations). Whether the principal components could be used in the context of a NN platform was tested. Some work has been reported recently using actual physical properties and neural networks in what is called a quantitative structure activity relationship (QSAR) (Tian et al., Amino. Acids 2009. 36: 535-554; Tian et al., Protein Pept. Lett. 2008. 15: 1033-1043. Huang et al., J. Theor. Biol. 2009. 256: 428-435). One of these articles used a huge array of physical properties in conjunction with complex multi-layer neural networks. However, method using physical properties directly suffers a major drawback in that there is really no way to know, or even to assess, what is the correct weighting of various physical properties. This is a major constraint as it is well known that the ability of NN to make predictions depends on the inputs being properly weighted (Bishop, C. M. (1995), Neural Networks for Pattern Recognition, Oxford: Oxford University Press. Patterson, D. (1996). Artificial Neural Networks. Singapore: Prentice Hall. Speckt, D. F. (1991). Δ Generalized Regression Neural Network. IEEE Transactions on Neural Networks 2 (6), 568-576). Besides simplifying the computations, appropriate weighting is a fundamental advantage of using the principal components of amino acids as proxies for the physical properties themselves. As FIG. 2 shows, the first three principal components accurately represent nearly 90% of all physical properties measured in 31 different studies.

Figure 3:
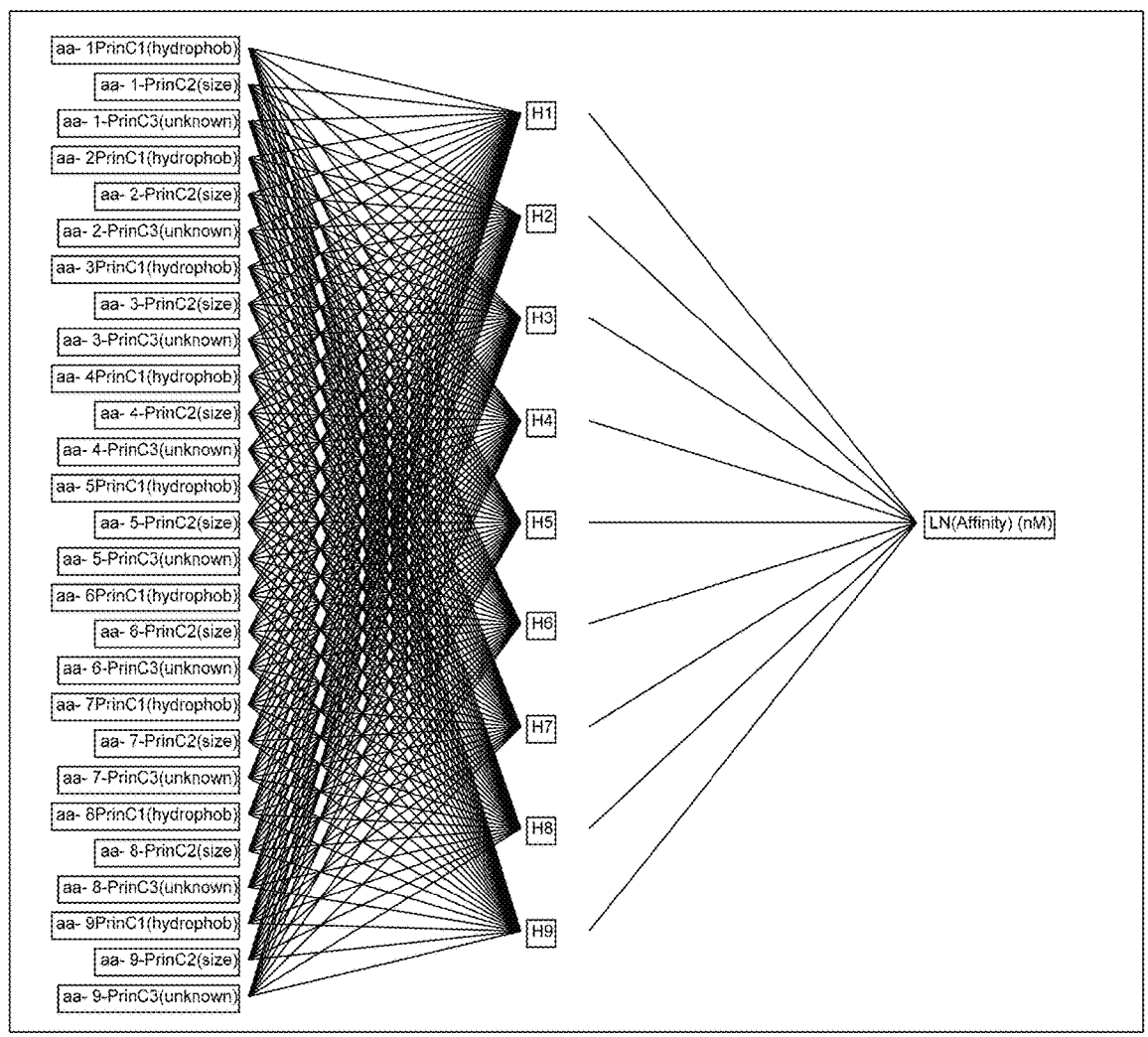
FIG. 3 provides a diagram of the Multi-layer Perceptron used for prediction of the binding affinity of a 9-mer peptide to an MHC-I molecule. This is a form of a Generalized Regression Neural Network with one hidden layer. The number of elements (nodes) in the hidden layer are directly related to the amino acids in the peptide and the physical molecular regions on the MHC binding pocket. For an MHC-II 15mer the number of items in the input and hidden layer increased accordingly.

Multi-layer Perceptron Design. In some embodiments, one or more principal components of amino acids within a peptide of a desired length are used as the input layer of a multilayer perceptron network. In some embodiments, the output layer is $LN(K_d)$ (the natural logarithm of the $K_d$) for that particular peptide binding to each particular MHC binding region. In some embodiments, the first three principal components in Table 3 were deployed as three uncorrelated physical property proxies as the input layer of a multi-layer perceptron (MLP) neural network (NN) regression process (4) the output layer of which is $LN(K_d)$ (the natural logarithm of the $K_d$) for that particular peptide binding to each particular MHC binding region. A diagram depicting the design of the MLP is shown in FIG. 3. The overall purpose is to produce a series of equations that allow the prediction of the binding affinity using the physical properties of the amino acids in the peptide n-mer under consideration as input parameters. Clearly more principal components could be used, however, the first three proved adequate for the purposes intended.

A number of decisions must be made in the design of the MLP. One of the major decisions is to determine what number of nodes to include in the hidden layer. For the NN to perform reliably, an optimum number of hidden notes in the MLP must be determined. There are many "rules of thumb" but the best method is to use an understanding of the underlying system, along with several statistical estimators, and followed by empirical testing to arrive at the optimum. Different MHC molecules have different sized binding pockets and have preferences for peptides of differing lengths. The binding pocket of MHC-I is closed on each end and will accommodate 8-10 amino acids and the size of the peptides in the MHC-I training sets used was 9 amino acids (9-mer). The molecular binding pocket of MHC-II is open on each end and will accommodate longer peptides up to 18-20 amino acids in length. In some embodiments, the number of hidden nodes is set to correlate to or be equal to the binding pocket domains. It would also be a relatively small step from PLS (linear) regression, but with the inherent ability of the NN to handle non-linearity providing an advantage in the fitting process. This choice emerged as a very good one for nearly all the available training sets. A diagram of the MLP for an MHC-I 9-mer is in FIG. 3. The MLP for MHC-II 15-mer contains 15 nodes in the hidden layer. In some embodiments, some of the other training sets that are available have different length peptides and the number of hidden nodes is set to be equal to the n-mers in the training set.

Training Sets and NN Quality Control. In developing NN predictive tools, a common feature is a process of cross validation of the results by use of "training sets" in the "learning" process. In practice, the prediction equations are computed using a subset of the training set and then tested against the remainder of the set to assess the reliability of the method. Binding affinities of peptides of known amino acid sequence have been determined experimentally and are publicly available at http://mhcbindingpredictions.immuneepitope.org/dataset.html. During training, the experimentally determined natural logarithm of the affinity of the particular peptide was used as the output layer. Most of the available training sets consist of about 450 peptides, whose binding affinity to various MHC molecules have been determined in the laboratory. To establish the generalize-ability of the predictions, a ⅓ random holdback cross validation procedure was used along with various statistical metrics to assess the performance of the NN. The computations were done on approximately 300 peptides of the 450 in the "training" sets and then the resulting equations were used to predict the remaining 150.

Methodology for the invention was developed using training sets for MHC binding available in 2010 these included training sets for 14 MHC-II alleles DRB1*0101, DRB1*0301, DRB1*0401, DRB1*0404, DRB1*0405, DRB1*0701, DRB1*0802, DRB1*0901, DRB1*1101, DRB1*1302, DRB1*1501, DRB3*0101, DRB4*0101, DRB5*0101, and 35 MHC-I alleles: A*0101, A*0201, A*0202, A*0203, A*0206, A*0301, A*1101, A*2301, A*2402, A*2403, A*2601, A*2902, A*3001, A*3002, A*3101, A*3301, A*6801, A*6802, A*6901, B*0702, B*0801, B*1501, B*1801, B*2705, B*3501, B*4001, B*4002, B*4402, B*4403, B*4501, B*5101, B*5301, B*5401, B*5701, B*5801. Training sets have since become available for a further 14 MHC-II alleles. Greenbaum et al., (2011) Functional classification of class II human leukocyte antigen (HLA) molecules reveals seven different supertypes and a surprising degree of repertoire sharing across supertypes. Immunogenetics. 10.1007/s00251-011-0513-0. The 14 additional MHC-II alleles were incorporated and applied in the methods as described herein and found to generate output consistent with the earlier 14 MHC-II and as described herein. It is anticipated that training sets for additional alleles will progressively become available and the processes and methods described herein are designed to incorporate these as they arise. Hence the list of alleles used herein is not limiting.

A common problem with NN development is "overfitting", or the propensity of the process to fit noise rather than just the desired data pattern in question. There are a number of statistical approaches that have been devised by which the degree of "overfitting" can be evaluated. NN development tools have various "overfitting penalties" that attempt to limit overfitting by controlling the convergence parameters of the fitting. The NN platform in JMP®, which we used, provides a method of $r^2$ statistical evaluation of the NN fitting process for the regression fits. Generally, the best model is derived through a series of empirical measurements. As a practical approach to dealing with the overfitting problem, an $r^2 \geq 0.9$ between the input and output affinities ($LN K_d$) for the entire training set was used as a fit that an experimentalist would find acceptable for experimental binding measurements. Then a variety of overfitting penalties were imposed on the NN fitting routine with a number of the training sets. The result was a selection of an overfitting penalty that consistently produced an $r^2$ in the desired range with the hidden nodes set to the binding pocket interactions described above. The absolute magnitude of the $r^2$ varied for the different training sets, and for different random seeds used to 'seed' the fitting routines, but were consistently in the desired range.

Figure 4:
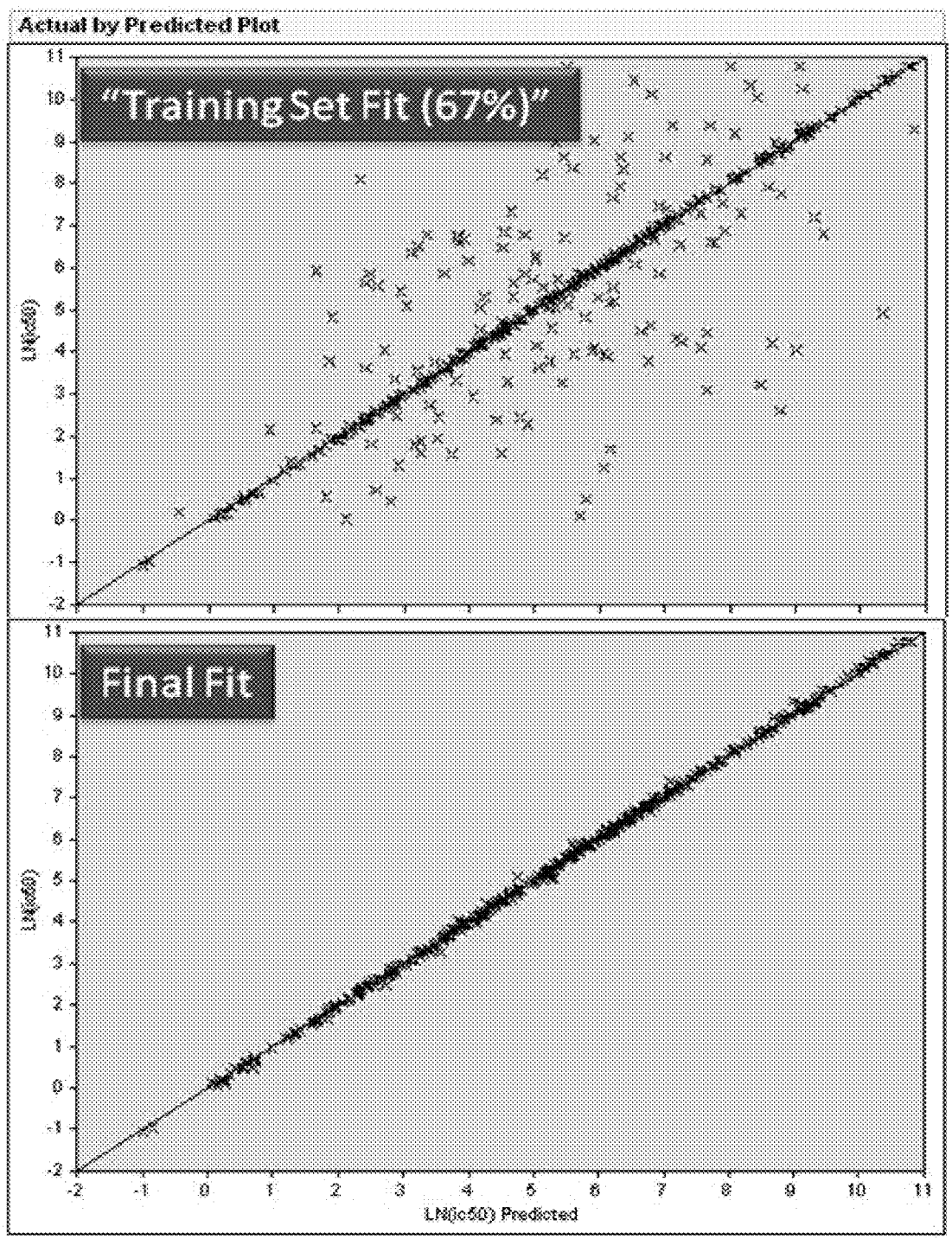
FIG. 4 provides an example of Neural Net ⅓ holdback cross-validation fitting of the training set for MHC_II DRB1_0404 (15-mer). In this case the final r2=0.94.

FIG. 4 is an example of the training and fitting process of the NN. There are several cross validation approaches and figure uses a ⅓ random holdback cross validation approach. By comparing the statistical parameters provided by the software and by examining the residuals, one can estimate the accuracy and reliability of the regression process.

Predictions of MHC_II Binding Affinities using the NN. A comparison of several processes for MHC_II affinity prediction is found in Table 3. Specifically the NN MLP (called PrinC-MHC_II-NN) and PLSR described above in this specification are compared to NetMHC II (version 2.0) and NetMHC II Pan (version 1.0) that are considered state-of-the-art immuno-bioinformatics approaches accessible from internet web servers (See, e.g., cbs.dtu. dk/services/NetMHC/). The identical 15-mer training sets used for developing the processes in this specification were contemporaneously submitted to the web servers and the output retrieved was compiled in the same database tables for statistical analysis in JMP® (v 8.0) (Nielsen, M. and Lund, O., BMC. Bioinformatics. 2009. 10: 296). The metric used to compare the different methods is the AROC. As can be seen, PrinC-MHC_II-NN all of the other methods by a substantial amount. Interestingly, and significantly, the superior performance was achieved using a substantially smaller number of hidden nodes than are used in the web servers.

The AROC for MHC_II DRB1_0101 (1 of the 44 different training sets for which NN were developed) showed relatively poor performance compared to the other alleles (see Table 4 row 1). Interestingly, NetMHC II also performs poorly with this training set suggesting that perhaps some unknown anomalies were present in the dataset itself which led to these differences. Some of information supplied with the training sets suggests that some of them have been developed by consolidation of experimental results from different laboratories which may be the source of the anomalies. Examination of the actual data and of residual plots clearly showed that indeed the training set for DRB1-0101 had anomalous characteristic as many of data points with the highest numerical value had the same numerical value which appears to be the cause of the rather peculiar flat edge on the residual scatter plot. Having a large number of datapoints with the exact same value is at odds with the physical reality and most likely relates to the difficulty of experimentally determining low affinity binding. Nevertheless, after some experimentation it was discovered that these anomalies could be accommodated for this particular allele by increasing the numbers of hidden nodes from 15 to 45 (Table 5).

TABLE 5

Effect of increasing numbers of nodes in the hidden layer of the multilayer perceptron for prediction of weak MHC II binders for allele DRB1_0101

| Hidden Nodes in MLP HLA DRB1 0101 | AUC ROC500 nM Weak Binder | $r^2$ |
|---|---|---|
| 15 | 0.6451 | 0.7959 |
| 30 | 0.7375 | 0.9009 |
| 45 | 0.8042 | 0.9591 |

With 30 hidden nodes PrinC-MHC_II performed significantly better than NetMHC_II and with 45 hidden nodes the performance improved considerably but still is not comparable to that of the other MHC_II predictions. For symmetry reasons the hidden nodes were kept as multiples of the underlying physical interactions. While an increase to 45 is a substantial, it is still quite a modest number relative to the number of hidden nodes used by NetMHC_II (Nielsen, M. and Lund, O., BMC. Bioinformatics. 2009. 10: 296)

Final Output of Process A. In some embodiments, the present invention provides a computer system or a computer readable medium comprising a NN trained to predict binding to each different HLA allele, which produces a set of equations that describe and predict the contribution of the physical properties of each amino acid to $\ln(K_d)$. Interestingly, the physical properties of the amino acids are being used to predict a number directly related to a thermodynamic property the Gibbs free energy: $\Delta G^0 = -RT \ln K$. In JMP®, these equations are stored in a format within the program for prediction of binding affinities of other peptides of equivalent length. Other statistical software may store the results differently for subsequent use. The JMP® statistical application that was used to produce the NN fits has a method of storing equations to define columns of numbers. A macro defining the NN output is connected to a column for each allele prediction. In practice, an empty table was created where an input peptide n-mer sequence would be defined a 3×(n-mer) vector of physical properties which in turn was used by equations of other columns to store the predicted $\ln(K_d)$. One column was assigned to each NN for which training had been done. Each Row of table Genome.GI.N.C. {pep1 . . . pepN}. {PC1 . . . PCN}. MHC-I{LN(Kd)1 . . . LN(Kd)j}. MHC-II{LN(Kd)1 . . . LN($K_d$)k}.

Each overlapping peptide in the proteome is assigned to one row in the data table. The number of columns in the data table varies depending on the size of peptide and the number of MHC allele affinities being predicted. Using the methodology above, predictive NN were developed for 35 MHC-I and 14 MHC-II molecules. The predictive ability of the NN was validated by comparing the results of the NN to the reference method. The NN produced showed a reliability greater than the established methods (Table 4). The NN prediction equations were stored in the JMP® platform system so that they could be applied to peptides from various proteomes (Process B). The neural net based on principal components is called PrinC MHC-II-NN.

Process "B": Determination of Peptide Binding to MHC

In some embodiments, the neural network described above is used to analyze all or a portion of a proteome, such as the proteome of an organism. Referring again to FIG. 1, in some embodiments, the proteome is analyzed by creating a series of N-mers for the proteome where each N-mer is offset+1 in the protein starting from the proteins' N-terminus (123456, 234567, etc.) (Step 6). Then, in some embodiments, each amino acid in each peptide is converted represented as one or more (e.g., 3 or from 1 to about 10) numbers based on the principal components (Step 7) as in Process "A". Thus, each 9-mer in the proteome is represented as a vector of 27 numbers. Then, in some embodiments, by applying the prediction equations (Step 5) from Process "A" on the output of (7) the $LN(K_d)$ is predicted (Step 10) for all MHC binding regions for which training sets were available and that were used to "train" the NN. In some embodiments, the results of (Step 10) are stored in a database table by Genome.GI.N.C. For example, Table 6 is a statistical summary of the results for MHC_II alleles for the surface proteome (surfome) of *Staphylococcus aureus* COL (Genbank genome accession number=NC_002951). The "surfome" consists of all proteins coded for in the genome that have a molecular signature(s) predicting their insertion in cell membranes.

TABLE 6

MHC II binding affinities for different fourteen alleles for all overlapping 15-mers in the surface proteome of Staphylococcus aureus COL NC_002951. The surface proteome consists of all proteins that have one or more predicted transmembrane helices in their structure. The statistics were derived from approximately 216,000 15-mers for 14 alleles or about 3.02 million binding predictions. The NN were trained and the predictions were made in the natural logarithmic domain (LN). The statistical parameters are for the entire proteome as this would constitute the population of peptides presented binding to MHC molecules on the surface of antigen presenting cells.

| MHC II Allele | Ave LN(IC50) | Std Dev LN(IC50) | 10%-tile LN(IC50) | Ave IC50 (nM) | Ave-SD IC50 (nM) | 10%-tile IC50 (nM) | Ave-2SD IC50 (nM) |
|---|---|---|---|---|---|---|---|
| DRB1_0101 | 4.48 | 3.11 | 0.54 | 88.27 | 3.95 | 1.72 | 0.18 |
| DRB1_0301 | 6.29 | 1.93 | 3.81 | 540.59 | 78.15 | 45.28 | 11.30 |
| DRB1_0401 | 5.31 | 2.59 | 1.95 | 202.23 | 15.12 | 7.04 | 1.13 |
| DRB1_0404 | 5.23 | 2.76 | 1.63 | 187.57 | 11.84 | 5.12 | 0.75 |
| DRB1_0405 | 4.38 | 1.90 | 1.92 | 79.92 | 11.96 | 6.81 | 1.79 |
| DRB1_0701 | 4.29 | 2.84 | 0.62 | 73.33 | 4.27 | 1.85 | 0.25 |
| DRB1_0802 | 7.05 | 2.00 | 4.48 | 1151.07 | 155.45 | 88.42 | 20.99 |
| DRB1_0901 | 5.85 | 2.48 | 2.64 | 346.90 | 29.03 | 13.99 | 2.43 |
| DRB1_1101 | 5.58 | 2.52 | 2.35 | 265.50 | 21.39 | 10.46 | 1.72 |
| DRB1_1302 | 7.14 | 1.95 | 4.62 | 1257.67 | 178.85 | 101.68 | 25.43 |
| DRB1_1501 | 5.86 | 2.74 | 2.31 | 351.12 | 22.61 | 10.07 | 1.46 |
| DRB3_0101 | 8.26 | 1.95 | 5.74 | 3861.57 | 547.81 | 312.37 | 77.71 |
| DRB4_0101 | 5.69 | 2.20 | 2.81 | 294.70 | 32.68 | 16.67 | 3.62 |
| DRB5_0101 | 4.92 | 2.60 | 1.58 | 136.76 | 10.12 | 4.85 | 0.75 |
| Average | 5.74 | 2.40 | 2.64 | 631.2 | 80.2 | 44.7 | 10.7 |
| Exp(Average) nM | 310.5 | 11.0 | 14.1 | | | | |

In some embodiments, the permuted minima for multiple HLA were used. In one example, these are set as the 25th percentile relative to the normal distribution about the permuted minimum. The mean permuted minimum for the different species is about −1.4 Standard Deviation units from the Standardized permuted mean. The standard deviation about the permuted minimum is 0.4. The cut point for the 25th percentile is −0.674 standard deviation units. Based on the initial standardized distribution this is −(1.4+0.674*0.4)=−1.67 standard deviation units or between the 5th and 10th percentile cut points of the main distribution.

Process "C": Determination of Protein Topology and of B-Cell Epitope Binding of Peptides Referring again to FIG. 1, in some embodiments, proteomes (1) are submitted to one of several publicly available programs for protein topology (e.g. phobius.binf.ku.dk; bioinf.cs.ucl.ac.uk/psipred/) These programs are quite accurate with areas under the ROC>0.9 and are used by genomic database centers as components in the curation of genomes. In some embodiments, the output of these programs is a topology prediction for each amino acid in the protein as being intracellular "i", extracellular "o", within a membrane "m" or a signal peptide "sp". It is also possible to obtain the actual Bayesian posterior probabilities from the programs as well but for this application it is not particularly helpful and a simple classification is adequate. In some embodiments, the result is a data table with the same number of rows as there are amino acids in the proteome coded as Genome.GI.N. topology coded as indicated.

In some embodiments, proteomes (Step 1) are submitted to one of several publicly available programs for B-cell epitope predictions (e.g., Bepipred) (Step 9). These programs have accuracies similar to one another and various comparisons of their classifications have been made. In other embodiments a NN multilayer perceptron was constructed based on amino acid principal components and using the randomly selected subsets of the B-cell epitope predictions of the publicly available B-Cell prediction programs for training. This strategy worked well and resulted in NN predictions that were equivalent to the original predictions. The overall accuracies of all B-cell prediction programs are somewhat lower than the MHC predictions, with an area under the ROC of ~0.8. The output of this step in the process is a Bayesian probability for each amino acid in the protein being in a B-cell epitope sequence. It is likely that the lower accuracy is due to the fact that an evolutionary selection process occurs in development, increasing B-cell affinity during an immune response, and hence the final outcome is not as discrete as the MHC_II binding. In some embodiments, the result of this process step is a data table with the same number of rows as there are amino acids in the proteome coded as Genome.GI.N.bepi_probability.

Process "D": Correlation of B-Cell and MHC Binding

In some embodiments, the results of steps (8), (9) and (10) are placed into a master data table for further analysis (Step 11). Each row in the database table contains a peptide 15-mer and each row indexes the peptide by +1 amino acid. For simplicity, the 9 mer used for MHC-I predictions is the "core" peptide with a tripeptide on each end of the 15-mer not involved in the prediction of MHC-I binding. In some embodiments, the data tables are maintained sorted by Genome, GI within the genome and N-terminus of the 15-mer peptide within GI (i.e. protein sequence).

There is a huge array of genetic variants of HLA molecules in the human population vastly more than there are peptide training sets. Further increasing the combinatorial possibilities is the fact that each individual has a diploid genome with MHC genes inherited from their parents and thus will have combinations of both parental genotypes of MHC on their cell membranes. Despite the combinatorial complexity, examination of the statistics of the predicted binding affinities to a number of different proteins in the proteome of Staphylococcus aureus gave rise to several discoveries which suggested that it would be possible to derive a system for determining the probability of binding not only for single haplotypes, but for all combinatorial haplotypes for which a trained NN was available. The approaches outlined above make it possible to put entire proteomes (or multiple proteomes) consisting of perhaps millions of binding affinities into a single data table, in a familiar spreadsheet interface on a standard personal workstation computer (high end better, obviously). By way of example Table 6 shows various statistics derived from approximately 216,000 overlapping 15-mers comprising 648 proteins in the surface proteome (surfome) of *Staphylococcus aureus* COL. It should be pointed out that the absolute numbers are slightly different for the other *Staph aureus* strain surfomes, but the general patterns are the same and thus the statistical concepts can be inferred to apply for all strains of *Staph. aureus*.

As noted above in the discussion of the NN development, an affinity (defined experimentally as an $IC_{50}$—the concentration at which half the peptide can be displaced from the binding site) of 500 nM (affinity of $2\times10^6 M^{-1}$) has been widely used to define a "weak binder" (WB) in immunoinformatics prediction schemes. We note that the results obtained with the *Staph aureus* COL surfome, the average peptide is classified in the weak binder range. A so-called "strong binder" (SB) is deemed to have a dissociation constant of less than 50 nM (affinity of $2\times10^7 M^{-1}$). As can be seen in Table 6 the SB threshold lies somewhere between the mean minus 1 standard (80.2 nM) and the 10 percentile point (44.7 nM). Since the 10 percentile was quite close to 50 nM point commonly used to conceptualize a strong binder, and it is a standard useful statistical cutoff, we selected the 10 percentile point as a useful threshold to derive the combinatorial statistics for the various MHC_II alleles. It is obvious that other thresholds could be used that would give somewhat different results.

In a diploid individual each presenting cell would display both parental alleles of DRB class MHC_II. There are other classes of MHC_II (DQB) and they would also contribute to the genetic diversity and binding complexity. No DQB training sets are available but it should be possible to extrapolate the general molecular concepts, should training sets become available.

As an example of DRB diversity based on the available training sets, Table 7 shows the predicted binding affinities for each of the DRB alleles in combination with each of the other DRB molecules (105 permutations). Inside an antigen presenting cell where peptides from digested organism (e.g. *Staph. aureus* COL) are coming into contact with MHC_II molecules, those molecule with higher affinity (smaller of the two LN affinity numbers) would be expected "win" and thus dominate in the binding process. Obviously, if the affinities were comparable then each of the different MHC_II molecules would have an equal binding probability. One of the striking features that emerges from this table (bottom rows Table 7) is the advantage of heterozygosity. Individuals randomly inheriting combinational pairs of the 14 alleles stands to have a higher binding affinity than if they had only one type. The heterozygosity advantage and the 10 percentile threshold, being in a range considered a useful biological range of affinity, suggested the possibility of averaging over all genotypes as a means of predicting binding in a population of individuals carrying MHC_II molecules of unknown genotype on their cells (as would be the case in a randomly selected vaccine population). These results suggest that combinatorial pairs of alleles need to be considered in statistical selection and screening processes.

TABLE 7

Ten percentile MHC II binding affinity statistics for 105 different heterozygous and homozygous allele combinations for 15-mer peptides from the surface proteome of *Staphylococcus aureus* COL. The results were obtained using 14 MHC II alleles for which training sets were available to train the NN. The surface proteome is defined as proteins that are predicted to have one or more transmembrane helices and are therefore expected to be inserted into the cell membrane.

| S1 | S2 | 10% tile S1 | 10% tile S2 | 10% tile Average | 10% tile min of pair |
|---|---|---|---|---|---|
| DRB1_0101 | DRB1_0101 | 0.54 | 0.54 | 0.54 | 0.54 |
| DRB1_0301 | DRB1_0301 | 3.81 | 3.81 | 3.81 | 3.81 |
| DRB1_0401 | DRB1_0401 | 1.95 | 1.95 | 1.95 | 1.95 |
| DRB1_0404 | DRB1_0404 | 1.63 | 1.63 | 1.63 | 1.63 |
| DRB1_0405 | DRB1_0405 | 1.92 | 1.92 | 1.92 | 1.92 |
| DRB1_0701 | DRB1_0701 | 0.62 | 0.62 | 0.62 | 0.62 |
| DRB1_0802 | DRB1_0802 | 4.48 | 4.48 | 4.48 | 4.48 |
| DRB1_0901 | DRB1_0901 | 2.64 | 2.64 | 2.64 | 2.64 |
| DRB1_1101 | DRB1_1101 | 2.35 | 2.35 | 2.35 | 2.35 |
| DRB1_1302 | DRB1_1302 | 4.62 | 4.62 | 4.62 | 4.62 |
| DRB1_1501 | DRB1_1501 | 2.31 | 2.31 | 2.31 | 2.31 |
| DRB3_0101 | DRB3_0101 | 5.74 | 5.74 | 5.74 | 5.74 |
| DRB4_0101 | DRB4_0101 | 2.81 | 2.81 | 2.81 | 2.81 |
| DRB5_0101 | DRB5_0101 | 1.58 | 1.58 | 1.58 | 1.58 |
| DRB1_0301 | DRB1_0101 | 3.81 | 0.54 | 2.175 | 0.54 |
| DRB1_0401 | DRB1_0301 | 1.95 | 3.81 | 2.88 | 1.95 |
| DRB1_0404 | DRB1_0401 | 1.63 | 1.95 | 1.79 | 1.63 |
| DRB1_0405 | DRB1_0404 | 1.92 | 1.63 | 1.775 | 1.63 |
| DRB1_0701 | DRB1_0405 | 0.62 | 1.92 | 1.27 | 0.62 |
| DRB1_0802 | DRB1_0701 | 4.48 | 0.62 | 2.55 | 0.62 |
| DRB1_0901 | DRB1_0802 | 2.64 | 4.48 | 3.56 | 2.64 |
| DRB1_1101 | DRB1_0901 | 2.35 | 2.64 | 2.495 | 2.35 |
| DRB1_1302 | DRB1_1101 | 4.62 | 2.35 | 3.485 | 2.35 |
| DRB1_1501 | DRB1_1302 | 2.31 | 4.62 | 3.465 | 2.31 |
| DRB3_0101 | DRB1_1501 | 5.74 | 2.31 | 4.025 | 2.31 |
| DRB4_0101 | DRB3_0101 | 2.81 | 5.74 | 4.275 | 2.81 |
| DRB5_0101 | DRB4_0101 | 1.58 | 2.81 | 2.195 | 1.58 |
| DRB1_0401 | DRB1_0101 | 1.95 | 0.54 | 1.245 | 0.54 |
| DRB1_0404 | DRB1_0301 | 1.63 | 3.81 | 2.72 | 1.63 |
| DRB1_0405 | DRB1_0401 | 1.92 | 1.95 | 1.935 | 1.92 |
| DRB1_0701 | DRB1_0404 | 0.62 | 1.63 | 1.125 | 0.62 |
| DRB1_0802 | DRB1_0405 | 4.48 | 1.92 | 3.2 | 1.92 |
| DRB1_0901 | DRB1_0701 | 2.64 | 0.62 | 1.63 | 0.62 |
| DRB1_1101 | DRB1_0802 | 2.35 | 4.48 | 3.415 | 2.35 |
| DRB1_1302 | DRB1_0901 | 4.62 | 2.64 | 3.63 | 2.64 |
| DRB1_1501 | DRB1_1101 | 2.31 | 2.35 | 2.33 | 2.31 |
| DRB3_0101 | DRB1_1302 | 5.74 | 4.62 | 5.18 | 4.62 |
| DRB4_0101 | DRB1_1501 | 2.81 | 2.31 | 2.56 | 2.31 |
| DRB5_0101 | DRB3_0101 | 1.58 | 5.74 | 3.66 | 1.58 |
| DRB1_0404 | DRB1_0101 | 1.63 | 0.54 | 1.085 | 0.54 |
| DRB1_0405 | DRB1_0301 | 1.92 | 3.81 | 2.865 | 1.92 |
| DRB1_0701 | DRB1_0401 | 0.62 | 1.95 | 1.285 | 0.62 |
| DRB1_0802 | DRB1_0404 | 4.48 | 1.63 | 3.055 | 1.63 |
| DRB1_0901 | DRB1_0405 | 2.64 | 1.92 | 2.28 | 1.92 |
| DRB1_1101 | DRB1_0701 | 2.35 | 0.62 | 1.485 | 0.62 |
| DRB1_1302 | DRB1_0802 | 4.62 | 4.48 | 4.55 | 4.48 |
| DRB1_1501 | DRB1_0901 | 2.31 | 2.64 | 2.475 | 2.31 |
| DRB3_0101 | DRB1_1101 | 5.74 | 2.35 | 4.045 | 2.35 |
| DRB4_0101 | DRB1_1302 | 2.81 | 4.62 | 3.715 | 2.81 |
| DRB5_0101 | DRB1_1501 | 1.58 | 2.31 | 1.945 | 1.58 |
| DRB1_0405 | DRB1_0101 | 1.92 | 0.54 | 1.23 | 0.54 |
| DRB1_0701 | DRB1_0301 | 0.62 | 3.81 | 2.215 | 0.62 |
| DRB1_0802 | DRB1_0401 | 4.48 | 1.95 | 3.215 | 1.95 |
| DRB1_0901 | DRB1_0404 | 2.64 | 1.63 | 2.135 | 1.63 |
| DRB1_1101 | DRB1_0405 | 2.35 | 1.92 | 2.135 | 1.92 |
| DRB1_1302 | DRB1_0701 | 4.62 | 0.62 | 2.62 | 0.62 |
| DRB1_1501 | DRB1_0802 | 2.31 | 4.48 | 3.395 | 2.31 |
| DRB3_0101 | DRB1_0901 | 5.74 | 2.64 | 4.19 | 2.64 |
| DRB4_0101 | DRB1_1101 | 2.81 | 2.35 | 2.58 | 2.35 |
| DRB5_0101 | DRB1_1302 | 1.58 | 4.62 | 3.1 | 1.58 |
| DRB1_0701 | DRB1_0101 | 0.62 | 0.54 | 0.58 | 0.54 |
| DRB1_0802 | DRB1_0301 | 4.48 | 3.81 | 4.145 | 3.81 |
| DRB1_0901 | DRB1_0401 | 2.64 | 1.95 | 2.295 | 1.95 |
| DRB1_1101 | DRB1_0404 | 2.35 | 1.63 | 1.99 | 1.63 |
| DRB1_1302 | DRB1_0405 | 4.62 | 1.92 | 3.27 | 1.92 |
| DRB1_1501 | DRB1_0701 | 2.31 | 0.62 | 1.465 | 0.62 |
| DRB3_0101 | DRB1_0802 | 5.74 | 4.48 | 5.11 | 4.48 |
| DRB4_0101 | DRB1_0901 | 2.81 | 2.64 | 2.725 | 2.64 |
| DRB5_0101 | DRB1_1101 | 1.58 | 2.35 | 1.965 | 1.58 |

TABLE 7-continued

Ten percentile MHC II binding affinity statistics for 105 different heterozygous and homozygous allele combinations for 15-mer peptides from the surface proteome of Staphylococcus aureus COL. The results were obtained using 14 MHC II alleles for which training sets were available to train the NN. The surface proteome is defined as proteins that are predicted to have one or more transmembrane helices and are therefore expected to be inserted into the cell membrane.

| S1 | S2 | 10% tile S1 | 10% tile S2 | 10% tile Average | 10% tile min of pair |
|---|---|---|---|---|---|
| DRB1_0802 | DRB1_0101 | 4.48 | 0.54 | 2.51 | 0.54 |
| DRB1_0901 | DRB1_0301 | 2.64 | 3.81 | 3.225 | 2.64 |
| DRB1_1101 | DRB1_0401 | 2.35 | 1.95 | 2.15 | 1.95 |
| DRB1_1302 | DRB1_0404 | 4.62 | 1.63 | 3.125 | 1.63 |
| DRB1_1501 | DRB1_0405 | 2.31 | 1.92 | 2.115 | 1.92 |
| DRB3_0101 | DRB1_0701 | 5.74 | 0.62 | 3.18 | 0.62 |
| DRB4_0101 | DRB1_0802 | 2.81 | 4.48 | 3.645 | 2.81 |
| DRB5_0101 | DRB1_0901 | 1.58 | 2.64 | 2.11 | 1.58 |
| DRB1_0901 | DRB1_0101 | 2.64 | 0.54 | 1.59 | 0.54 |
| DRB1_1101 | DRB1_0301 | 2.35 | 3.81 | 3.08 | 2.35 |
| DRB1_1302 | DRB1_0401 | 4.62 | 1.95 | 3.285 | 1.95 |
| DRB1_1501 | DRB1_0404 | 2.31 | 1.63 | 1.97 | 1.63 |
| DRB3_0101 | DRB1_0405 | 5.74 | 1.92 | 3.83 | 1.92 |
| DRB4_0101 | DRB1_0701 | 2.81 | 0.62 | 1.715 | 0.62 |
| DRB5_0101 | DRB1_0802 | 1.58 | 4.48 | 3.03 | 1.58 |
| DRB1_1101 | DRB1_0101 | 2.35 | 0.54 | 1.445 | 0.54 |
| DRB1_1302 | DRB1_0301 | 4.62 | 3.81 | 4.215 | 3.81 |
| DRB1_1501 | DRB1_0401 | 2.31 | 1.95 | 2.13 | 1.95 |
| DRB3_0101 | DRB1_0404 | 5.74 | 1.63 | 3.685 | 1.63 |
| DRB4_0101 | DRB1_0405 | 2.81 | 1.92 | 2.365 | 1.92 |
| DRB5_0101 | DRB1_0701 | 1.58 | 0.62 | 1.1 | 0.62 |
| DRB1_1302 | DRB1_0101 | 4.62 | 0.54 | 2.58 | 0.54 |
| DRB1_1501 | DRB1_0301 | 2.31 | 3.81 | 3.06 | 2.31 |
| DRB3_0101 | DRB1_0401 | 5.74 | 1.95 | 3.845 | 1.95 |
| DRB4_0101 | DRB1_0404 | 2.81 | 1.63 | 2.22 | 1.63 |
| DRB5_0101 | DRB1_0405 | 1.58 | 1.92 | 1.75 | 1.58 |
| DRB1_1501 | DRB1_0101 | 2.31 | 0.54 | 1.425 | 0.54 |
| DRB3_0101 | DRB1_0301 | 5.74 | 3.81 | 4.775 | 3.81 |
| DRB4_0101 | DRB1_0401 | 2.81 | 1.95 | 2.38 | 1.95 |
| DRB5_0101 | DRB1_0404 | 1.58 | 1.63 | 1.605 | 1.58 |
| DRB3_0101 | DRB1_0101 | 5.74 | 0.54 | 3.14 | 0.54 |
| DRB4_0101 | DRB1_0301 | 2.81 | 3.81 | 3.31 | 2.81 |
| DRB5_0101 | DRB1_0401 | 1.58 | 1.95 | 1.765 | 1.58 |
| DRB4_0101 | DRB1_0101 | 2.81 | 0.54 | 1.675 | 0.54 |
| DRB5_0101 | DRB1_0301 | 1.58 | 3.81 | 2.695 | 1.58 |
| DRB5_0101 | DRB1_0101 | 1.58 | 0.54 | 1.06 | 0.54 |
| | Mean | 2.92 | 2.37 | 2.64 | 1.88 |
| | Std Dev | 1.47 | 1.41 | 1.07 | 1.08 |

In some embodiments, to facilitate further statistical procedures, the binding affinities (as natural logarithms) are standardized. Standardization is a statistical process where the data points are transformed to a mean of zero and a standard deviation of one. In this way all binding affinities of all different alleles, and paired allele combinations, are put on the same basis for further computations. The process is reversible, and thus statistical characteristics detected can be converted back to physical binding affinities. All of the proteins in the Staph aureus surfome, comprising about 216,000 15-mers, were used for a "global standardization process". By using all the 15-mers for standardization, the statistical processes are brought into line with the biological process where an engulfed foreign organism would be digested and the peptides presented would be the repertoire of the entire organism. Furthermore, the construction of normally distributed populations provides a means of rigorous and meaningful statistical screening and selection processes from normal Gaussian distributions.

The underlying complexity of the peptide binding statistics at a proteomic scale point out the need to carefully consider the appropriate methodology; this is demonstrated in the following figures. For purposes of comparison assume that rather than global standardization (the standardization which were done on the 216,000 15-mers) it was done on an individual protein basis. If all proteins were similar then averaging each of these individually standardized binding affinities would also lead to a zero mean and unit standard deviation for the population. But this is not the case because the proteins are different and the binding characteristics of the alleles vary as well. This can be seen by examining the characteristics of the normalized binding affinity histograms. The binding affinity for each of the MHC_II alleles was globally standardized for all 15-mers in the 648 surfome and as can be seen the histograms for the 216,000 15-mers (FIG. 5a) are indeed centered on zero and have a standard deviation of one. The corresponding histograms (FIG. 5b) is the same data standardized globally but then the standardized binding affinities averaged for each protein, leading to the histogram for 648 protein means. Some of the distributions are nearly normal but many are highly skewed. In addition the distributions are not zero centered with unit standard deviation. Thus, for appropriate statistical and biologically relevant selection it is essential to carry out the selection process on normally distributed data as obtained by the global standardization process. It is thought that the skewed distributions in FIG. 5b) are the result of the contributions of proteins with multiple transmembrane helices. Overall the transmembrane domains have the highest binding affinities and some proteins have many transmembrane domains. There are other proteins with long extracellular segments with long stretches of low binding affinity.

In some embodiments, the Bayesian probabilities for each individual amino acid being in a B-cell epitope produced by the BepiPred program (Table 1) are subjected to a global standardization like that described for the MHC binding affinities described above. Thus all the peptides that will be subject to statistical screening are standardized so that selections made on normal population distributions probabilities can be made.

In some embodiments, following these two processes, the data tables contained columns of the original predicted binding affinity data for the different MHC alleles (as natural logarithms) and the original B-cell epitope probabilities, as well as corresponding columns of standardized (zero mean, unit standard deviation) data of the immunologically relevant endpoints.

Figure 6:
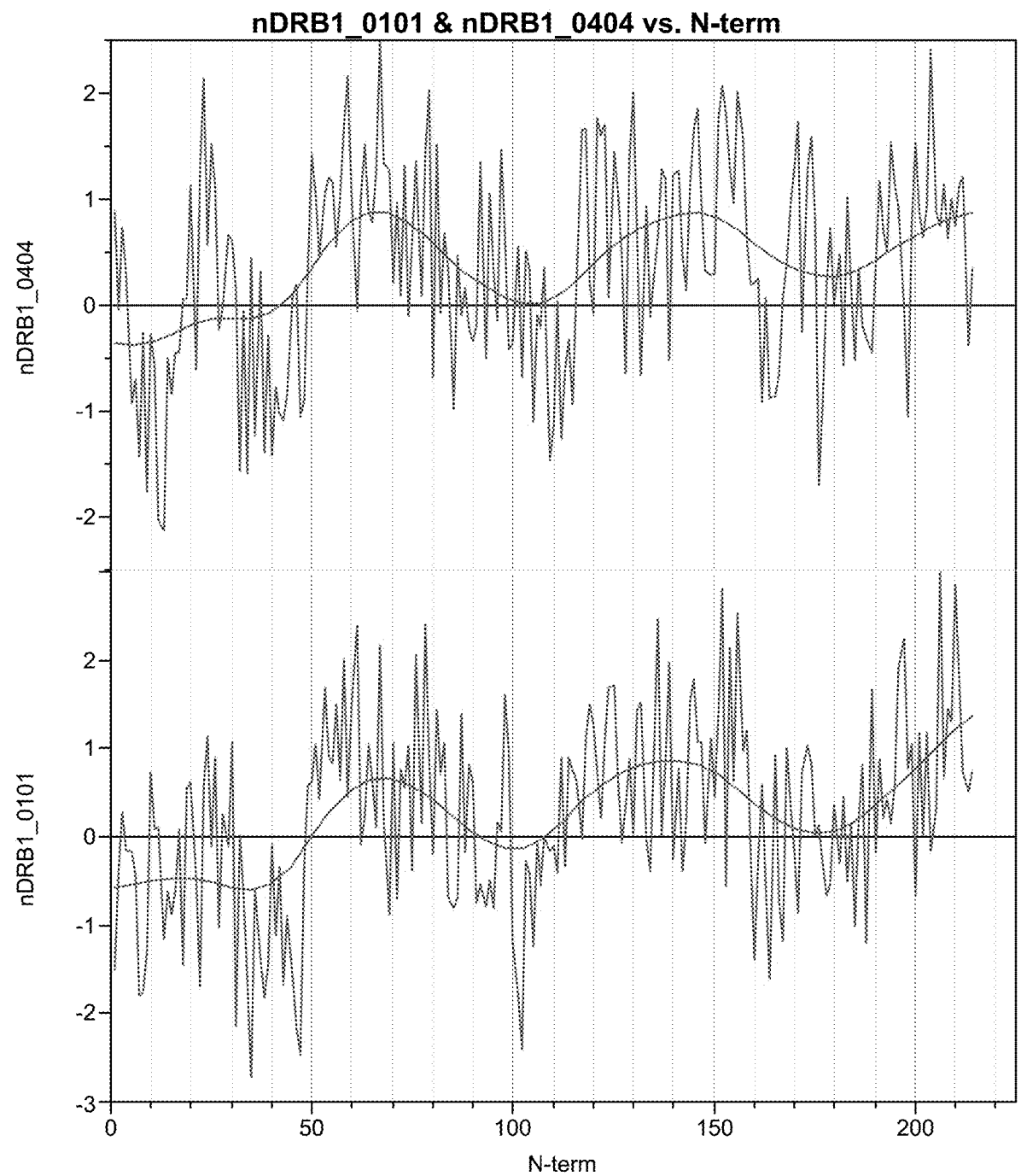
FIG. 6 provides a comparison of the standardized affinities for two different MHC_II molecules DRB1_0101 and DRB1_0401. Note that while the 15-mer is indexed by one amino acid very wide variations in binding affinity are predicted but the line which is a long range average over a 20 amino acids shows an undulating pattern which is very similar between the two different molecules.
Figure 7:
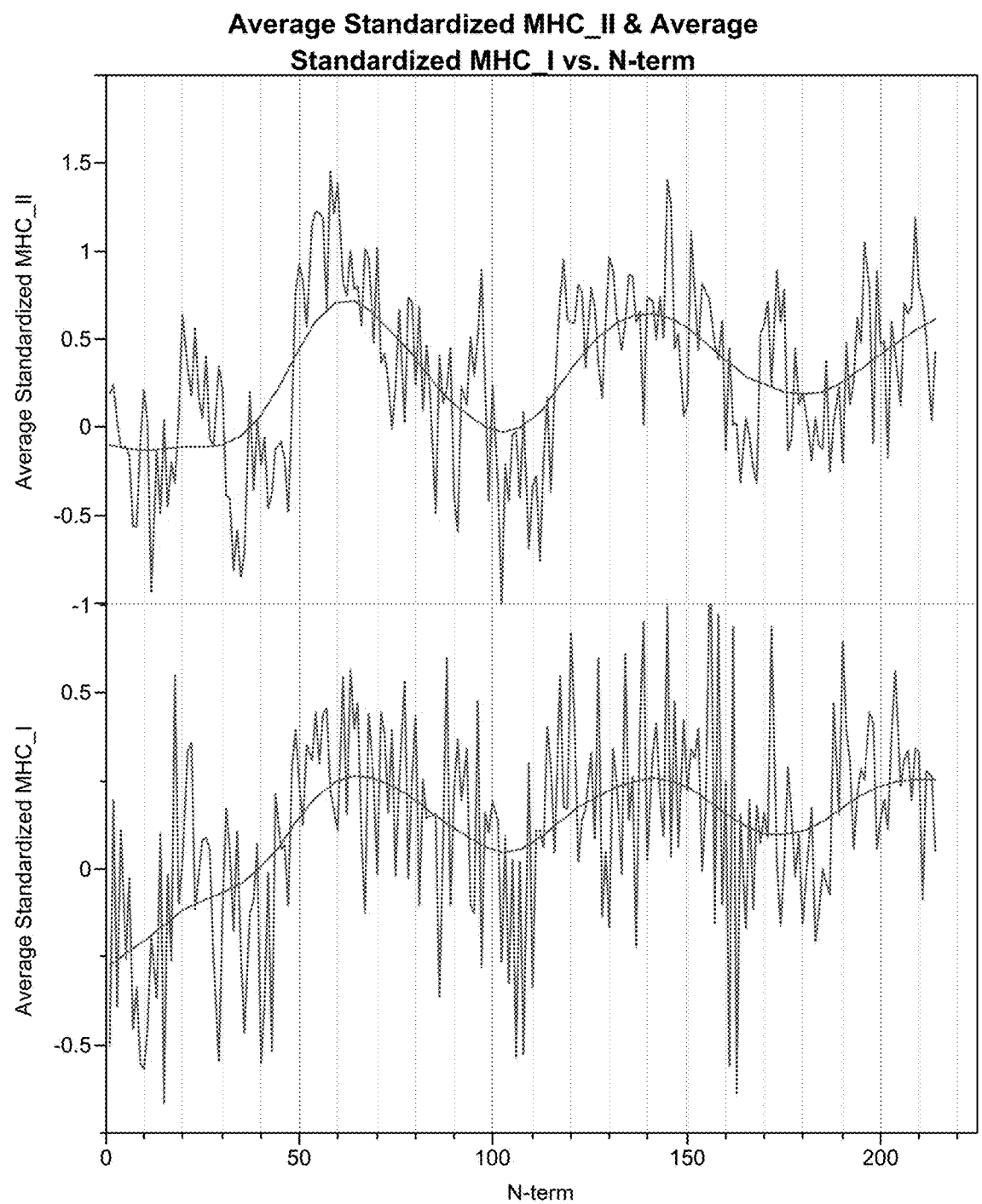
FIG. 7 depicts the average of standardized binding affinity for 14 MHC_II compared with the average of standardized binding affinities for 35 MHC I HLA alleles.

It was discovered by examining the plots of many different proteins with different types of data portrayal that, despite individual 15-mer peptides showing widely different predicted binding affinities for the different MHC alleles, there was a tendency for high binding for all alleles in certain regions of molecules and low binding in others. This can be seen by undulations in the averaged mean affinities across a protein sequence. Not only was this the case among MHC II alleles, but was also seen with the averages of all MHC I and MHC II alleles (FIG. 6 and FIG. 7). It emerged that each protein has a characteristic undulation pattern regardless of the allele.

Based on these observations a system was devised to compute an average of standardized affinities for the permuted pairs of for all alleles within an adjustable (filtering) window. The window is defined as a stretch of contiguous amino acids over which averaging was carried out. Various windows (filtering stringencies) were tested, but the most useful smoothing was achieved with a window of ±half the size of the binding peptide i.e. ±7 amino acids for MHC II alleles and ±4 amino acids for MHC I alleles. The smoothing algorithms of Savitsky and Golay (Savitzky, A. and Golay, M. J. E., Anal. Chem. 1964. 36: 1627-1639)] adjusted for the binding window can also be used to advantage as this method does not distort the data like a simple running average. In the time-space domain of peptide-protein molecular dynamics this effectively implies that a given peptide has the possibility of binding to the MHC in a number of amino acid positions within a small distance upstream or downstream of the protein index position being considered. For MHC II this is reasonably simple to envisage as the ends of the pocket are open and peptides longer than 15 amino acids could undergo rapid association:dissociation until the highest binding configuration is found. For MHC-I with closed ends on the binding pocket the possibilities are more limited. Another factor, which is not possible to include in the predictions at this point, is the effect of the differential proteolysis that will contribute to the variable lengths of peptide with a possibility to interact with a binding pocket.

Figure 8:
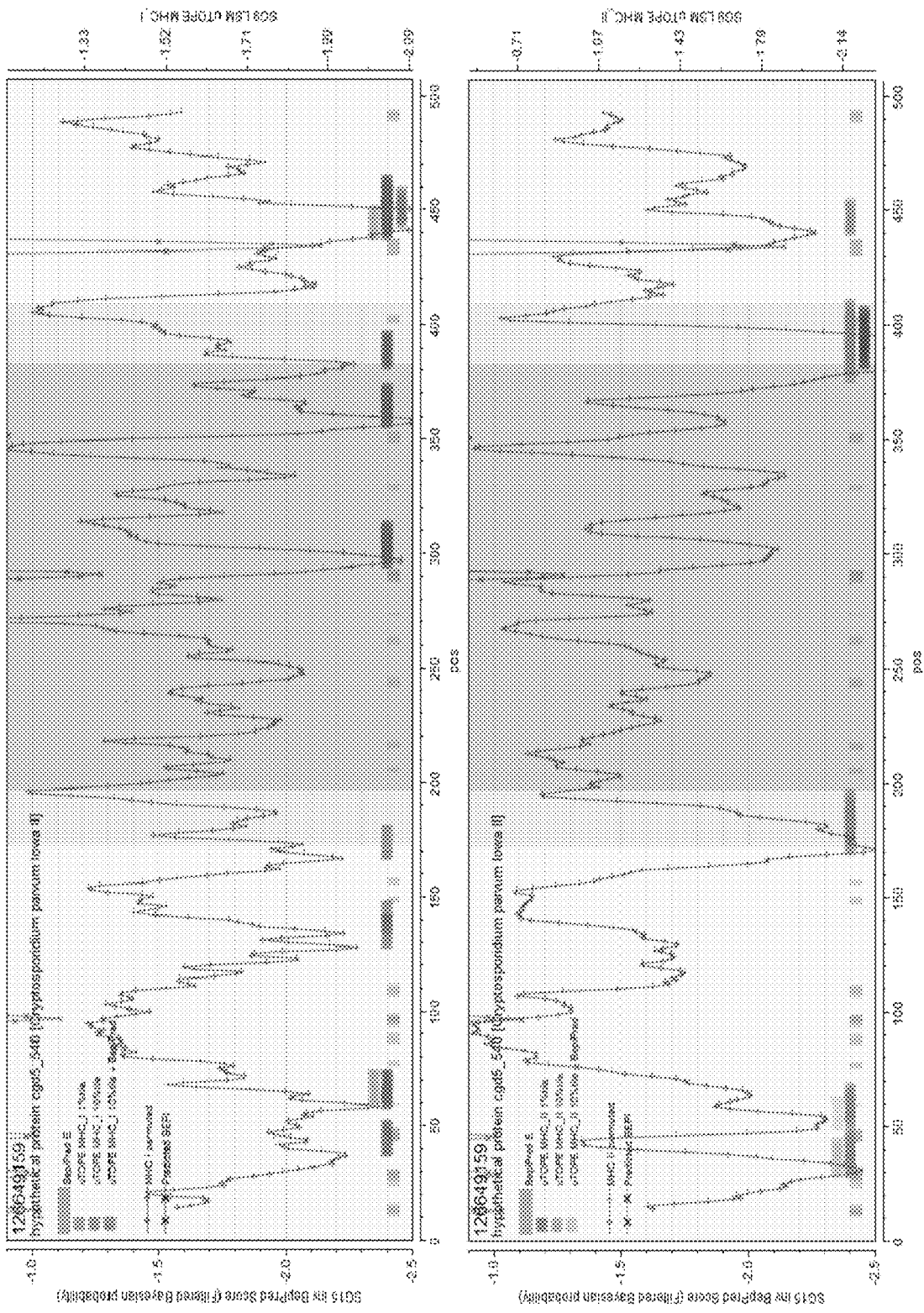
FIG. 8. Graphic depiction of a protein predicted to have B-cell epitope sequences and coincident B-cell epitope sequences and MHC binding regions. Topology: yellow=extracellular domain, green=membrane domains and fuchsia=intracellular domain. Red lines indicate B cell epitope sequence probability. Blue lines shows the average minimum for a window of 9 amino acids for permuted HLA alleles. Orange rectangles are regions where B-cell epitope sequences exceeds the 10 percentile region. Grey bars show MHC-I binding regions meeting 10 percentile criterion; tan bars are MHC-I bars meeting 1% criterion; lilac bars are MHC-I binding regions within top 10 percentile coincident with a B-cell epitope sequences. Blue bars show MHC_II binding regions meeting 10 percentile criterion; brown bars=MHCII binding regions that meet the 1 percentile criterion. Green bars show MHC-II binding coincident with BEPI. The lines are the windowed, permuted, standardized, averages of the MHC I and MHC II and standardized B-cell epitope sequence probabilities. They axis is in standard deviation units.
Figure 9:
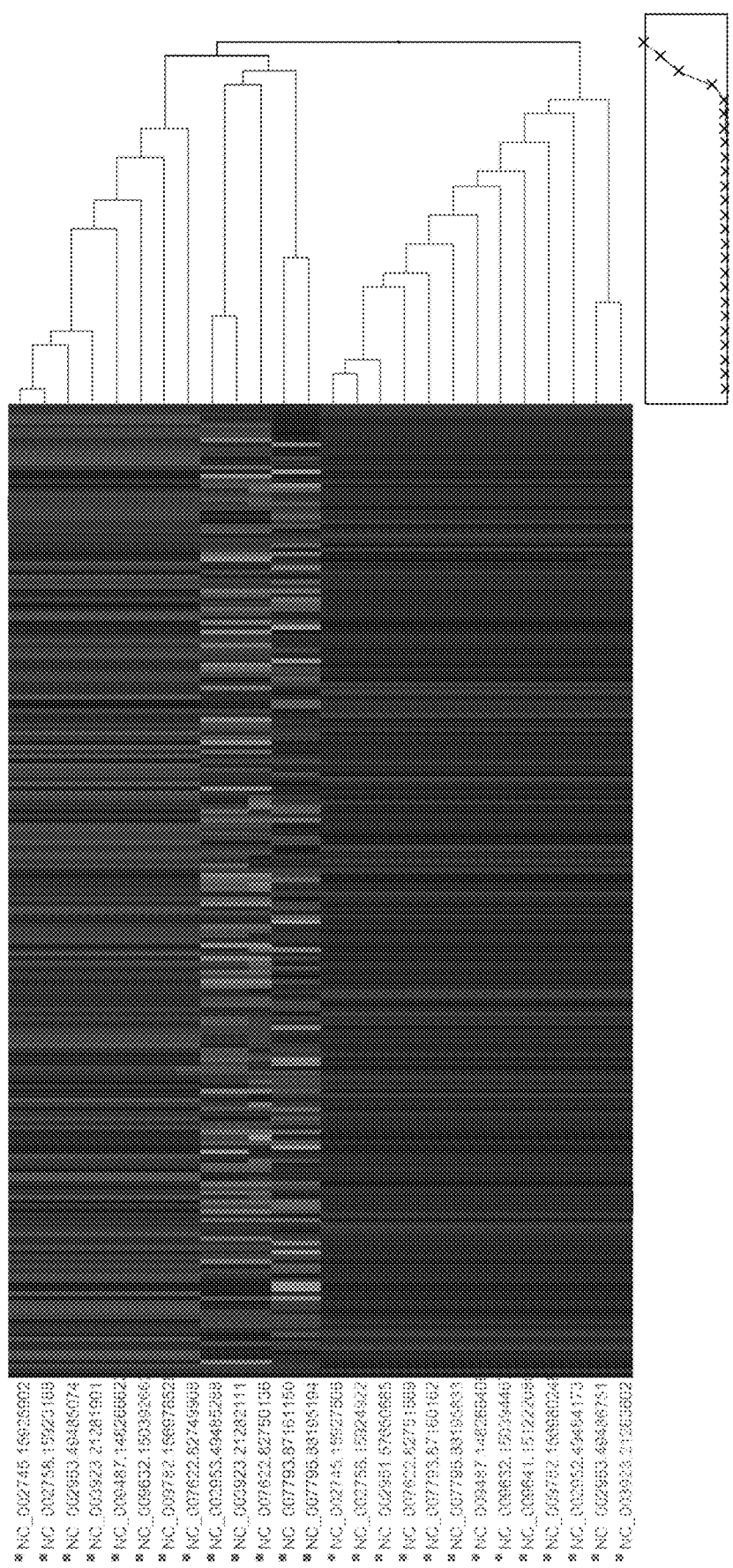
FIG. 9 shows clustering of proteins with 226 amino acids from all strains of *Staphylococcus aureus* proteomes showing four different clusters. One of the clusters is found in 13 strains whereas the others are found in fewer strains. For clustering the alphabetic characters of all amino acids were replaced with a number that corresponded to the first principal component of the physical properties of that amino acid this made it possible to use standard statistical routines to do the clustering.
Figure 10:
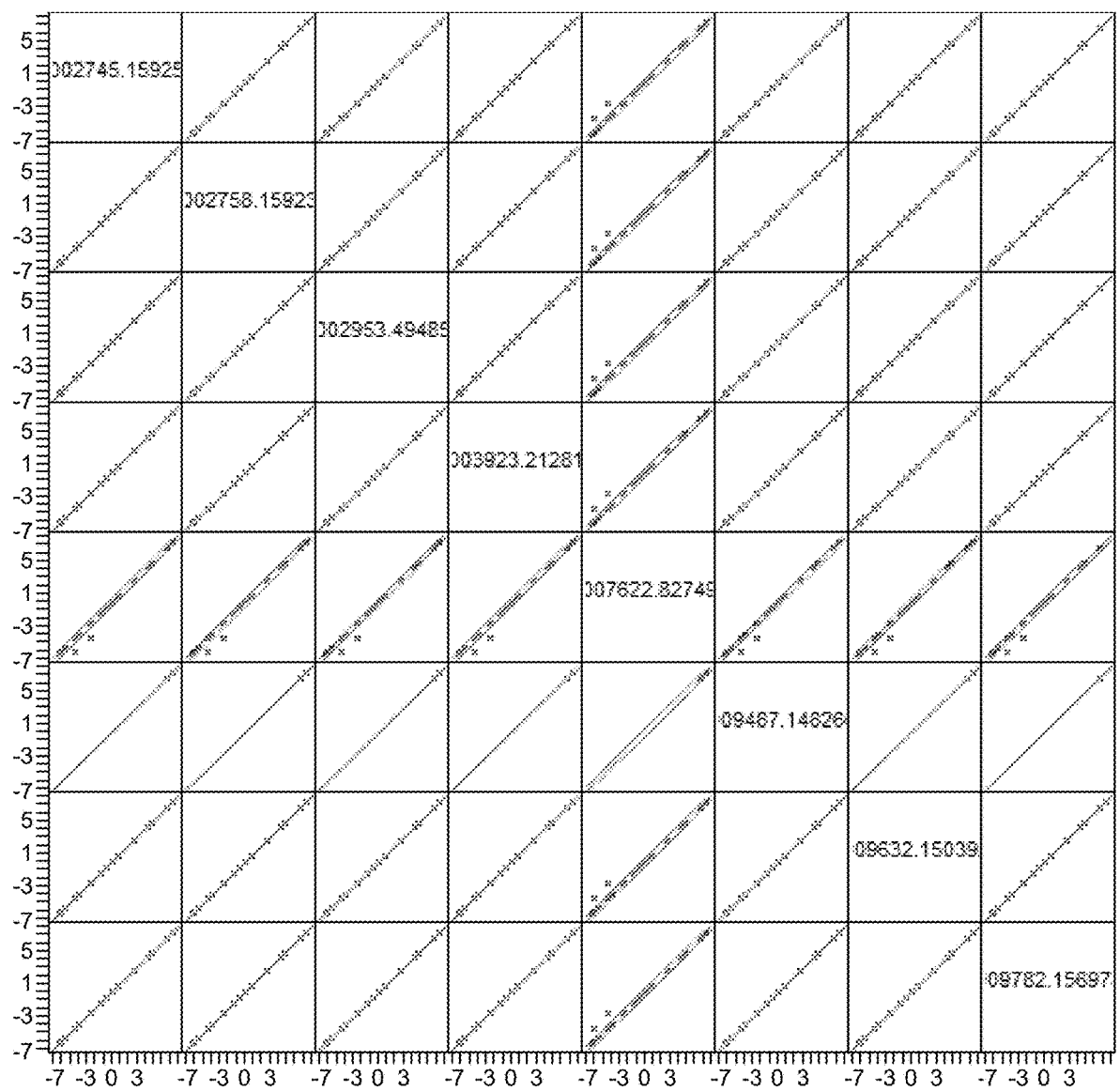
FIG. 10 shows the cluster from FIG. 9 viewed as a scatter plot matrix of matching physical properties. This cluster is found in 8 of the 13 proteomes of *Staphylococcus aureus*.
Figure 11:
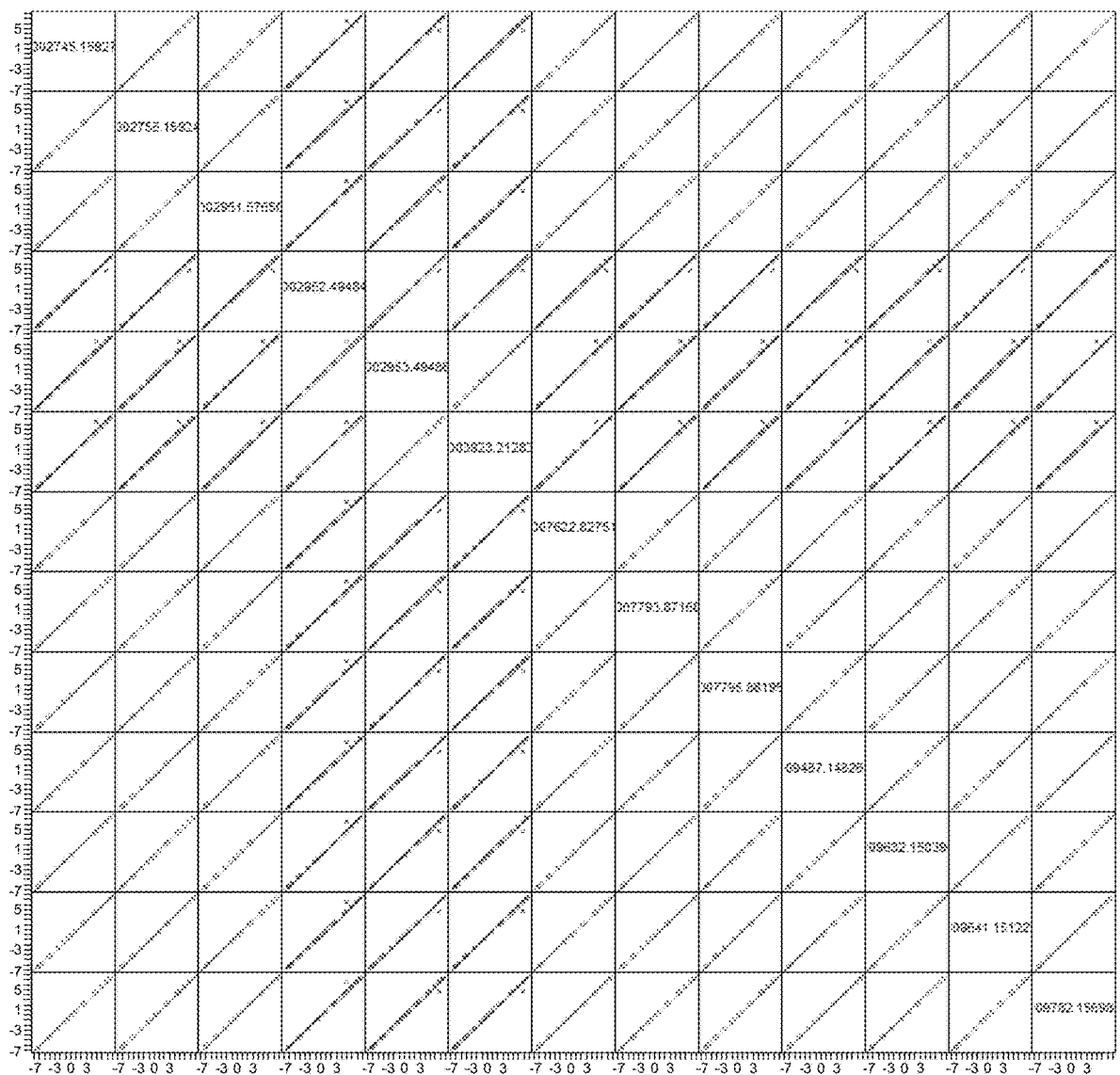
FIG. 11 shows the cluster from FIG. 9 viewed as a scatter plot matrix of matching physical properties. This cluster is found in 13 of the 13 proteomes of *Staphylococcus aureus*.
Figure 12:
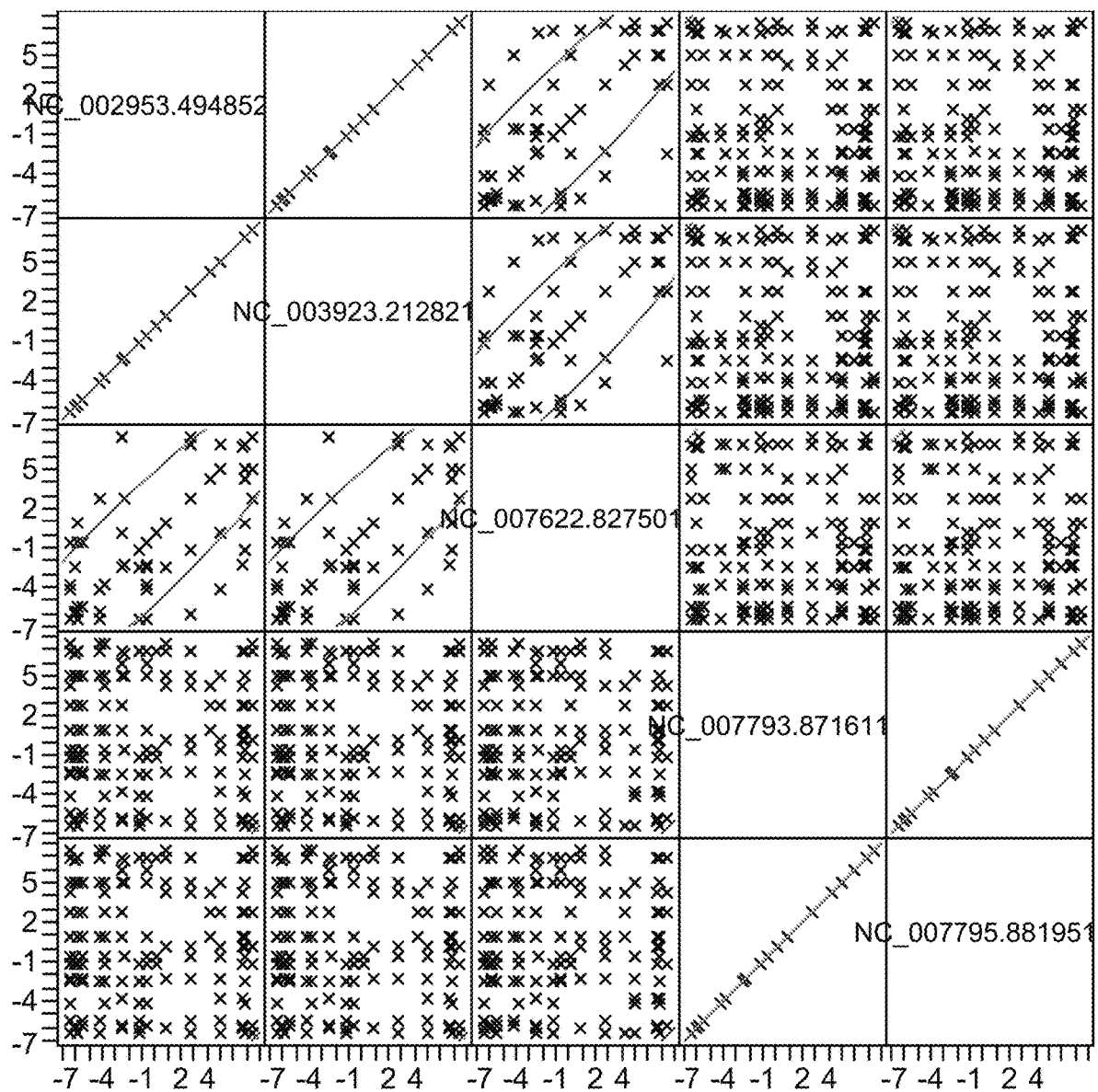
FIG. 12 shows the cluster from FIG. 9 viewed as a scatter plot matrix of matching physical properties. This is a complex type of pattern not readily seen in the clustering output but more readily detected in this mode of display. The clusters in this scatter plot matrix are found in a minority of proteomes. Clustering algorithms have difficulty appropriately discerning small clusters. In this pattern there are two, two-protein clusters, one almost match pair and several that do not match at all.

In some embodiments, the output of these computational processes were plotted, overlaid with the topology as shown in FIG. 8, and tabulated in the database (See SEQ ID LISTING). In some embodiments, elected regions of proteins where peptides meet at least one of three criteria: both MHC binding threshold and the B-cell epitope probability threshold were in the 10 percentile range and the run of amino acids in the predicted B-cell epitope peptide was ≥4 amino acids. Selection of the 10th percentile in two characteristics in normally distributed variables on a probability basis should a product of two probabilities or in about a 1% coincidence where MHC binding regions overlapped either partially or completely with predicted B-epitope regions. A graphical scheme (Step 13) was developed that made it possible to readily visualize the topology of proteins at the surface of the organism as well as 3 normal probabilities MHC I MHC II and B-epitopes (see FIG. 8). Predictions for MHC I and MHC II were done routinely although it is recognized that MHC I are generally for intracellular infectious organisms and MHC II are for extracellular organisms. In the case of *Staphylococcus aureus* recent work has suggested that the organism, while generally thought of an extracellular organism, actually has some characteristics of an intracellular organism as well.

Process "E" Determination of Epitopes Conserved Across Organismal Strains

In some embodiments, selected peptides are found in all strains of an organism (e.g., a bacteria) of interest. In some embodiments, proteins are assigned into sets based on their size and amino acid sequence across different organismal strains. These matches are called Nearly Identical Protein Sets (NIPS). Various methods could be used to accomplish this. Multiple alignment procedures such as BLAST could be used, for example. After some testing, it was found that by re-coding the amino acid sequence into a vector consisting of the 1st principal component of the particular amino acid (~polarity score) the vectors could be clustered using the clustering algorithms in standard statistical software approach (Step 12). As a primary criterion proteins were sorted into groups of the equivalent numbers of amino acids. Then, the groups with the same numbers of amino acids were submitted analyzed by clustering of amino acid 1st principal component (polarity) of proteins and the clusters were verified by pairwise correlation. FIGS. 9, 10, 11 and 12 demonstrate the types of patterns found and show the utility of this approach to matching proteins across proteomes.

Process Output (Step 14 in FIG. 1)

In some embodiments, output from the various process steps are consolidated into database tables (Step 13 in FIG. 1) using standard database management software. Those skilled in the art will recognize that a variety of standard methods and software tools are available for manipulation, extraction, querying, and analysis of data stored in databases. By using standardized database designs these tools can readily be used individually or in combinations. All subsequent reports and graphical output are done using standard procedures.

B. Sources of Epitopes

The present invention can be used to analyze, identify and provide epitopes (e.g., a synthetic or recombinant polypeptide comprising a B-cell epitope and/or peptides that bind to one or more members of an MHC or HLA superfamily) from a variety of different sources. The present invention is not limited to the use of sequence information from a particular source or type or organism. The epitopes may be of synthetic or natural origin. Likewise, the present invention is not limited to the use of sequence information from an entire proteome, partial proteomes can also be used with this invention, e.g., amino acid sequences comprising 10%, 20%, 30%, 40%, 50%, 60%, 70%, 80%, or 90% of the entire proteome of the organism. Indeed, the invention may be applied to the sequences of individual proteins or sequence information for sets of proteins, such as transmembrane proteins.

The present invention is especially useful for identifying epitopes that are conserved across different strains or an organism. Examples of organisms are provided in Table 14A and B in Example 13. In some embodiments, the source of the epitopes is one or more strains of *Staphylococcus aureus*, including, but not limited to, those identified in Tables 14A and B in Example 13. In some embodiments, the source of the epitopes is one or more species of *Mycobacterium*, for example, those identified in Tables 14A and B in Example 13. In some embodiments, the source of the epitopes is one or more species of *Giardia intestinalis, Entamoeba histolytica*, influenza A, *Plasmodium, Francisella* spp, and species and strains further identified in tables 14A and B of Example 13. In some embodiments, the source of the epitopes is one or more strains or *M. tuberculosis*, including, but not limited to H37Rv, H37Ra, F11, KZN 1435 and CDC1551. In some embodiments, the source of the epitopes is one or more strains or *Mycobacterium avium*, including, but not limited to 104 and paratuberculosis K10. In some embodiments, the source of the epitopes is one or more strains or M *ulcerans*, including, but not limited to Agy99. In some embodiments, the source of the epitopes is one or more strains or *M. abcessus*, including, but not limited to ATCC 19977. In some embodiments, the source of the epitopes is one or more strains or *M. leprae*, including, but not limited to TN and Br4923. In some embodiments, the source of the epitopes is one or more species of *Cryptosporidium*, for example, *C. hominus* and *C. parvum*. In some embodiments, the source of the epitopes is one or more strains or *C. hominus*, including, but not limited to TU502. In some embodiments, the source of the epitopes is one or more strains or *C. parvum*, including, but not limited to Iowa II.

In some embodiments, the sequence information used to identify epitopes is from an organism. Exemplary organisms include, but are not limited to, prokaryotic and eukaryotic organisms, bacteria, archaea, protozoas, viruses, fungi, helminthes, etc. In some embodiments, the organism is a pathogenic organism. In some embodiments, the proteome is derived from a tissue or cell type. Exemplary tissues and cell types include, but are not limited to, carcinomas, tumors, cancer cells, etc. In other embodiments the sequence information is from a synthetic protein.

In some embodiments, the microorganism is *Francisella* spp., *Bartonella* spp., *Borrelia* spp., *Campylobacter* spp., *Chlamydia* spp., *Simkania* spp., *Escherichia* spp. *Ehrlichia* spp. *Clostridium* spp., *Enterococcus* spp., *Haemophilius* spp., *Coccidioides* spp., *Bordetella* spp., *Coxiella* spp., *Ureaplasma* spp., *Mycoplasma* spp., *Trichomatis* spp., *Helicobacter* spp., *Legionella* spp., *Mycobacterium* spp., *Corynebacterium* spp., *Rhodococcus* spp., *Rickettsia* spp., *Arcanobacterium* spp., *Bacillus* spp., *Listeria* spp., *Yersinia* spp., *Shigella* spp., *Neisseria* spp., *Streptococcus* spp., *Staphylococcus* spp., *Vibrio* spp., *Salmonella* spp., *Treponema* spp., *Brucella* spp., *Campylobacter* spp., *Shigella* spp., *Mycoplasma* spp., *Pasteurella* spp., *Pseudomonas* ssp., and *Burkholderii* spp Human and porcine rhinovirus, Human coronavirus, Dengue virus, Filoviruses (e.g., Marburg and Ebola viruses), Hantavirus, Rift Valley virus, Hepatitis B, C, and E, Human Immunodeficiency Virus (e.g., HIV-1, HIV-2), HHV-8, Human papillomavirus, Herpes virus (e.g., HV-I and HV-II), Human T-cell lymphotrophic viruses (e.g., HTLV-I and HTLV-II), Bovine leukemia virus, Influenza virus, Guanarito virus, Lassa virus, Measles virus, Rubella virus, Mumps virus, Chickenpox (Varicella virus), Monkey pox, Epstein Bahr virus, Norwalk (and Norwalk-like) viruses, Rotavirus, Parvovirus B19, Hantaan virus, Sin Nombre virus, Venezuelan equine encephalitis, Sabia virus, West Nile virus, Yellow Fever virus, causative agents of transmissible spongiform encephalopathies, Creutzfeldt-Jakob disease agent, variant Creutzfeldt-Jakob disease agent, *Candida, Cryptcoocus, Cryptosporidium, Giardia lamblia*, Microsporidia, *Plasmodium vivax, Pneumocystis carinii, Toxoplasma gondii, Trichophyton mentagrophytes, Enterocytozoon bieneusi, Cyclospora cayetanensis, Encephalitozoon hellem, Encephalitozoon cuniculi, Ancylostama, Strongylus, Trichostrongylus, Haemonchus, Ostertagia, Ascaris, Toxascaris, Uncinaria, Trichuris, Dirofilaria, Toxocara, Necator, Enterobius, Strongyloides* and *Wuchereria; Acanthamoeba* and other amoebae, *Cryptosporidium, Fasciola, Hartmanella, Acanthamoeba, Giardia lamblia, Isospora belli, Leishmania, Naegleria, Plasmodium* spp., *Pneumocystis carinii, Schistosoma* spp., *Toxoplasma gondii*, and *Trypanosoma* spp., among other viruses, bacteria, archaea, protozoa, fungi, and the like).

Some examples are given below to illustrate the impact of infectious disease and hence the need to develop more effective vaccines, therapeutics, and diagnostic aids. The present invention addresses the identification of peptide epitopes which can be used to develop vaccines, drugs and diagnostics of use in combating such diseases. The examples cited below serve to illustrate the scope of the problem and should not be considered limiting.

*Staphylococcus aureus. Staphylococcus* species are ubiquitous in the flora of skin and human contact surfaces and are frequent opportunist pathogens of wounds, viral pneumonias, and the gastrointestinal tract. In 2005 MRSA caused almost 100,000 reported cases and 18,650 deaths in the United States, exceeding the number of deaths directly attributed to AIDs (Klevens et al. 2006. Emerg. Infect. Dis. 12:1991-1993; Klevens et al. 2007. JAMA 298:1763-1771). Staphylococci have become the leading cause of nosocomial infections (Kuehnert et al. 2005. Emerg. Infect. Dis. 11:868-872). *Staph. aureus* is the most common infection of surgical wounds, responsible for increased inpatient time, with increased costs mortality rates. Outcome is particularly severe with methicillin resistant *Staph. aureus* (MRSA) (Anderson and Kaye. 2009. Infect. Dis. Clin. North Am. 23:53-72). MRSA infections are also commonly associated with catheters, ulcers, ventilators, and prostheses. MRSA infections are now disseminated in the community with infections arising as a result of surface contact in schools, gyms and childcare facilities (Kellner et al. 2009. 2007. Morbidity and Mortality Weekly Reports 58:52-55; Klevans, 2006; Miller and Kaplan. 2009. Infect. Dis. Clin. North Am. 23:35-52). MRSA infections are increasingly prevalent in HIV patients (Thompson and Torriani. 2006. Curr. HIV./AIDS Rep. 3:107-112). The impact of MRSA in tropical and developing countries is under-documented but clearly widespread (Nickerson et al. 2009 Lancet Infect. Dis. 9:130-135). *Staphylococcus* is recognized as a serious complication of influenza viral pneumonia contributing to increased mortality (Kallen et al. 2009. Ann. Emerg. Med. 53:358-365).

*Mycobacterium* spp. Tuberculosis (TB) is one of the world's deadliest diseases: one third of the world's population are infected with TB. Each year, over 9 million people around the world become sick with TB and there are almost 2 million TB-related deaths worldwide. Tuberculosis is a leading killer of those who are HIV infected. (Centers for Disease Control. Tuberculosis Data and Statistics. 2009.) In total, 13,299 TB cases (a rate of 4.4 cases per 100,000 persons) were reported in the United States in 2007. Increasingly *Mycobacterium tuberculosis* is resistant to antibiotics; a worldwide survey maintained since 1994 shows up to 25% of strains are multidrug resistant (Wright et al. 2009. Lancet 373:1861-1873).

Other *Mycobacterium* species are also causes of serious disease including leprosy (*Mycobacterium leprae*) and Buruli ulcer (M *ulcerans*), both of which cause disfiguring skin disease. In 2002, WHO listed Brazil, Madagascar, Mozambique, Tanzania, and Nepal as having 90% of cases of the approximately 750,000 cases of leprosy, whereas Buruli ulcer was prevalent primarily in Africa (Huygen et al. 2009. Med. Microbiol. Immunol. 198:69-77).

Cholera. Cholera, one of the world's oldest recognized bacterial infections, continues to cause epidemics in areas disrupted by fighting and refugee crises. The Rwandan displacements of the mid 1990s were accompanied by large cholera outbreaks. More currently Mozambique, Zambia and Angola have been the site of cholera outbreaks affecting thousands. From August 2008 through February 2009 70,643 cases of cholera and 3,467 deaths have been reported in Zimbabwe (Bhattacharya et al. 2009. Science 324:885).

Pneumonias. Bacterial pneumonias are common both as the result of primary infection and where bacterial infection is a secondary consequence of viral pneumonia. *Streptococcus pneumoniae* is the most common cause of community-acquired pneumonia, meningitis, and bacteremia in children and adults (Lynch and Zhanel. 2009. Semin. Respir. Crit Care Med. 30:189-209), with highest prevalence in young children, those over 65 and individuals with impaired immune systems. Increasingly Strep. *pneumoniae* is antibiotic resistant (Lynch and Zhanel. 2009. Semin. Respir. Crit Care Med. 30:210-238). Until 2000, Strep. *pneumoniae* infections caused 100,000-135,000 hospitalizations for pneumonia, 6 million cases of otitis media, and 60,000 cases of invasive disease, including 3,300 cases of meningitis. Disease figures are now changing somewhat due to vaccine introduction (Centers for Disease Control and Prevention. *Streptococcus pneumoniae* Disease. 2009). MRSA is emerging as a cause of bacterial pneumonia arising from nosocomial infections (Hidron et al. 2009. Lancet Infect. Dis. 9:384-392). In the 1918 influenza epidemic, bacterial secondary infections are thought to have caused over half the deaths (Brundage and Shanks. 2008. Emerg. Infect. Dis.

14:1193-1199). There is now speculation as to the role MRSA or antibiotic resistant streptococcal infections may play as a secondary pathogen in influenza pandemics (Rothberg et al. 2008. Am. J. Med. 121:258-264.

Trachoma. Trachoma, caused by *Chlamydia trachomatis*, is the leading cause of infectious blindness worldwide. It is known to be highly correlated with poverty, limited access to healthcare services and water. In 2003, the WHO estimated that 84 million people were suffering from active trachoma, and 7.6 million were severely visually impaired or blind as a result of trachoma (Mariotti et al. 2009. Br. J. Ophthalmol. 93:563-568).

Spirochetes. Lyme Disease, caused by the tick borne spirochaete, Borelia burgdoferi, is the most common arthropod borne disease in the United States. In 2007, 27,444 cases of Lyme disease were reported yielding a national average of 9.1 cases per 100,000 persons. In the ten states where Lyme disease is most common, the average was 34.7 cases per 100,000 persons (Centers for Disease Control and Prevention. Lyme Disease. 2009). Lyme disease causes arthritis, skin rashes and various neurological signs and can have long term sequalae (Shapiro, E. D. and M. A. Gerber. 2000. Clin. Infect. Dis. 31:533-542). Protozoa. Malaria, caused by *Plasmodium* spp and most importantly *P. falciparum*, is one of the three leading causes cause of death in Africa, where over 90% of the world cases occur (Nchinda T L. Emerging Infect. Dis. 4; 398-403, 1998). Each year 350-500 million cases of malaria occur worldwide, and over one million people die, most of them young children in Africa south of the Sahara (Centers for Disease Control and Prevention. Malaria. 2009). While simple interventions such as mosquito control and use of bed nets contributed to important reductions in incidence, the need for effective therapeutics continues. Worldwide spread of *Plasmodium falciparum* drug resistance to conventional antimalarials, chloroquine and sulfadoxine/pyrimethamine, has been imposing a serious public health problem in many endemic regions (Mita T, Parasit Int. 58: 201-209, 2009).

Kinetoplastid diseases including African Trypanosomiasis, (Chagas disease) and leishmaniasis are among the major killers worldwide. Human African trypanosomiasis (HAT)—also known as sleeping sickness—is caused by infection with one of two parasites: *Trypanosoma brucei rhodesiense* or *Trypanosoma brucei gambiense*. These organisms are extra-cellular protozoan parasites that are transmitted by insect vectors in the genus *Glossina* (tsetse flies). While the epidemiology of the two species differ, together they are responsible for 70,000 reported cases per year and likely a very high number of cases go unreported (Fevre et al. 2008. PLoS. Negl. Trop. Dis. 2:e333).

Chagas disease, or American trypanosomiasis, is caused by the parasite *Trypanosoma cruzi*. Infection is most commonly acquired through contact with the feces of an infected triatomine bug, a blood-sucking insect that feeds on humans and animals. Chagas disease is endemic throughout much of Mexico, Central America, and South America where an estimated 8 to 11 million people are infected (Centers for Disease Control. Chagas Disease: Epidemiology and Risk Factors. 2009. World Health Organization. Global Burden of Disease 2004. 2008. World Health Organization).

Leishmaniasis is caused by multiple species of *Leishmania*, which are transmitted by the bite of sandflies. Over 1.5 million new cases of cutaneous leishmanaisis occur each year and half a million cases of visceral leishmanaiasis ("kala-azar") (Centers for Disease Control. Leishmanaisis. 2009). WHO ranks leishmaniasis as the infectious disease having the fifth greatest impact (calculated in DALYs or disability adjusted life years) (World Health Organization. Global Burden of Disease 2004. 2008. World Health Organization).

Three protozoal infections, entamoebiasis, cryptosporidiosis and giardiasis, are major contributors to diarrheal disease. Childhood diarrheas are the second leading cause of death in the tropics resulting in over 2 million deaths per year and are considered a neglected disease in need of R&D effort to provide therapeutics and preventatives (Moran et al. Neglected Disease Research and Development: How Much Are We Really Spending? 2-1-2009. Health Policy Division, The George Institute for International Health. G-Finder).

Cryptosporidiosis, entamoebiasis, and giardiasis are water borne diseases and often occur together, contributing to neonatal deaths and chronic maladsorption and malnutrition. This can result in stunted growth and cognitive development with lifelong effects (Dillingham et al. 2002. Microbes Infect 4:1059).

A closely related protozoan, *Toxoplasma gondii*, a zoonosis transmitted by cat and other animals, is one of the commonest parasitic infections estimate to have infected one third of the human population. It is the commonest cause of uveitis both congenitally and adult and contributes to a number of other neurologic diseases (Dubey, J. P. 2008. J. Eukaryot. Microbiol. 55:467-475. Dubey, J. P. and J. L. Jones. 2008. Int. J. Parasitol. 38:1257-1278).

Viruses. Viral diseases are among those with greatest impact and epidemic potential. Annually 300,000 to 500,000 death resulting from influenza occur worldwide; the influenza pandemic of 1918 reportedly caused over 20 million deaths, while immediately following the emergence of Hong Kong H3N2 influenza in 1967 2 million deaths occurred from the infection. Dengue is now the most important arthropod-borne viral disease globally; WHO estimates more than 50 million infections annually, 500,000 clinical cases and 20,000 deaths. An estimated 2.5 billion people are at risk in over 100 countries throughout the tropics. The sudden emergence of SARS coronavirus in 2003 lead to very rapid worldwide spread; within 6 weeks of its discovery it had infected thousands of people around the world, including people in Asia, Australia, Europe, Africa, and North and South America causing severe respiratory distress and deaths. Many other viral diseases are widespread and have serious consequences both as primary impacts through acute disease, as well as secondary impacts as triggers of cancer and autoimmune disease. Viral diseases include but are not limited to adenovirus, Coxsackievirus, Epstein-Barr virus, Hepatitis A virus, Hepatitis B virus, Hepatitis C virus, Herpes simplex virus type 1, Herpes simplex virus type 2, HIV, Human herpesvirus type 8, Human papillomavirus, Influenza virus, measles, Poliomyelitis, Rabies, Respiratory syncytial virus, Rubella virus, herpes zoster, and rotavirus.

Fungi. A number of fungal pathogens cause important systemic disease. Coccidiodomycosis is a serious pulmonary disease prevalent in the Southwestern US (Blair et al. 2008. Clin. Infect. Dis. 47:1513-1518.) and which increasingly is reported in older patients. *Cryptococcus neoformans* is a fungal pathogens that causes menigioencephalitis especially in immunocompromised patients (Lin and Hei, 2006. The biology of the *Cryptococcus neoformans* species complex. Annu. Rev. Microbiol. 60:69-105). Histoplasmosis and blastomycosis are very common fungal pulmonary pathogens in the United States, often disseminated in dried bird and animal fecal material (Kauffman 2006. Infect. Dis. Clin. North Am. 20:645-62; Kauffman, 2007. Clin. Microbiol. Rev. 20:115-132).

Helminth infections. Helmith infections are also major contributors worldwide to the burden of disease. Filariasis, schistosomiasis, ascariasis, trichuriasis, onchocerciasis and hookworm disease are among the top fifteen contributors to the infectious disease burden (World Health Organization. Global Burden of Disease 2004. 2008. World Health Organization.) and are featured in the list of neglected tropical diseases (WHO at who.int/neglected_diseases/diseases/en/).

Veterinary Medical infections. The disclosure above outlines the impact of infectious disease in humans. Infectious diseases are also important economic burdens to livestock production. Mastitis, pneumonias and diarrheal diseases are among the most important bacterial and parasitic infections which afflict livestock populations with serious economic consequences. The epitope identification strategies that are the subject of this application are equally relevant to diseases afflicting species other than humans and many of the organisms for which peptide epitopes have been identified are zoonotic.

Non-infectious diseases. Many of the major non-infectious diseases cause characteristic epitopes to be displayed on the surface of cells. Cancers may be divided into two types, those associated with an underlying viral etiology and those which arise from a mutation of genes which control cell growth and division. In both cases, the surface epitopes may differ from normal cells either through expression of viral coded epitopes or overexpression of normal self proteins (e.g., HER-2 human epidermal growth factor receptor 2 overexpression in some breast cancers)(Sundaram et al. 2002. Biopolymers 66:200-216). The appearance of distinct epitopes offers the opportunity to target immunotherapies and vaccines to tumor cells (Sundaram et al., 2002 Biopolymers (Pept Sci), 66:200-216; Loo and Mather. 2008. Curr. Opin. Pharmacol. 8:627-631; Reichertand Valge-Archer. 2007. Nat. Rev. Drug Discov. 6:349-356; King et al. 2008. QJM. 101:675-683).

Accordingly, in some embodiments, the protein or peptide sequence information used to identify epitopes is from a cancer or tumor. Examples include, but are not limited to, sequence information from bladder carcinomas, breast carcinomas, colon carcinomas, kidney carcinomas, liver carcinomas, lung carcinomas, including small cell lung cancer, esophagus carcinomas, gall-bladder carcinomas, ovary carcinomas, pancreas carcinomas, stomach carcinomas, cervix carcinomas, thyroid carcinomas, prostate carcinomas, and skin carcinomas, including squamous cell carcinoma and basal cell carcinoma; hematopoietic tumors of lymphoid lineage, including leukemia, acute lymphocytic leukemia, acute lymphoblastic leukemia, B-cell lymphoma, T-cell-lymphoma, Hodgkin's lymphoma, non-Hodgkin's lymphoma, hairy cell lymphoma and Burkett's lymphoma; hematopoietic tumors of myeloid lineage, including acute and chronic myclogenous leukemias, myelodysplastic syndrome and promyelocytic leukemia; tumors of mesenchymal origin, including fibrosarcoma and rhabdomyosarcoma; tumors of the central and peripheral nervous system, including astrocytoma, neuroblastoma, glioma and schwannomas; and other tumors, including melanoma, seminoma, teratocarcinoma, osteosarcoma, xeroderma pigmentosum, keratoxanthoma, thyroid follicular cancer and Kaposi's sarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, leiomyosarcoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma. In some embodiments, sequence information from individual proteins from the cancer cells are analyzed for epitopes according the process of the present invention. In some embodiments, sequence information from a set of proteins, such as transmembrane proteins, from the cancer cells are analyzed for epitopes according to the process of the present invention.

A number of diseases have also been identified as the result of autoimmune reactions in which the body's adaptive immune defenses are turned upon itself. Among the diseases recognized to be the result of autoimmunity, or to have an autoimmune component are celiac disease, narcolepsy, rheumatoid arthritis and multiple sclerosis (Jones, E. Y. et al, 2006. Nat. Rev. Immunol. 6:271-282). In a number of other instances infections are known to lead to a subsequent autoimmune reaction, including, for example but not limited to, in Lyme Disease, Streptococcal infections, and chronic respiratory infections (Hildenbrand, P. et al, 2009. Am. J. Neuroradiol. 30:1079-1087; Lee, J. L. et al, Autoimmun. Rev. 10.1016 0.2009; Leidinger, P. et al Respir. Res. 10:20, 2009). Enhanced ability to define and characterize peptides which form epitopes on the surface of cells in autoimmune will therefore facilitate the development of interventions which can ameliorate such diseases. Accordingly, in some embodiments, sequence information from cells that are involved in an autoimmune reaction or disease is analyzed according to the methods of the present invention. In some embodiments, sequence information from individual proteins from the cells are analyzed for epitopes according the process of the present invention. In some embodiments, sequence information from a set of proteins, such as transmembrane proteins, from the cells are analyzed for epitopes according to the process of the present invention.

In some particular embodiments the autoimmune diseases are those affecting the skin, which often cause autoimmune blistering diseases. These include but are not limited to pemphigus vulgaris and pemphigus foliaceus, bullous pemphigoid, paraneoplastic pemphigus, pemphigoid gestationis, mucous membrane pemphigus, linear IgA disease, Anti-Laminin pemphigoid, and epidermolysis bullosa aquisitiva. Some of the proteins which have been implicated as the target of the autoimmune response include desmogelin 1,3 and 4, E-adherin, alpha 9 acetyl choline receptor, pemphaxin, plakoglobin, plakin, envoplakin, desmoplakin, BP 180, BP230, desmocholin, laminin, type VII collagen, tissue transglutaminase, endomysium, anexin, ubiquitin, Castlemans disease immunoglobulin, and gliadin. This list is illustrative and should not be considered limiting. In some instances peptides which bind antibodies and thus contain B cell epitopes have been described. Giudice et al., Bullous pemphigoid and herpes gestationis autoantibodies recognize a common non-collagenous site on the BP180 ectodomain. J Immunol 1993, 151:5742-5750; Giudice et al., Cloning and primary structural analysis of the bullous pemphigoid autoantigen BP180. J Invest Dermatol 1992, 99:243-250; Salato et al., Role of intramolecular epitope spreading in pemphigus vulgaris. Clin Immunol 2005, 116:54-64; Bhol et al., Correlation of peptide specificity and IgG subclass with pathogenic and nonpathogenic autoantibodies in pemphigus vulgaris: a model for autoimmunity. Proc Natl Acad Sci USA 1995, 92:5239-5243. Further T cell epitopes have been characterized Hacker-Foegen et al., T cell receptor gene usage of BP180-specific T lymphocytes from patients with bullous pemphigoid and pemphigoid gestationis. Clin Immunol 2004, 113:179-186. However, no systematic attempt has been made to plot the occurrence of all MHC binding regions and B cell eptiopes in the proteins associated with cutaneous autoimmune disease, nor to determine the coincidence of B-cell epitopes with high affinity MHC binding regions.

In some embodiments, the present invention provides peptides from the aforementioned proteins associated with cutaneous autoimmune diseases which have characteristics of B cell epitopes and which bind with high affinity to MHC molecules, whether those two features are in overlapping or contiguous peptides or peptides that are bordering within 3 amino acids of each other.

A number of autoimmune disorders have been linked to immune responses triggered by infectious organisms which bear immune mimics of self-tissue epitopes. Examples include, but are not limited to, Guillan Barre (Yuki N (2001) *Lancet Infect Dis* 1 (1): 29-37, Yuki N (2005) *Curr Opin Immunol* 17 (6): 577-582; Kieseier B C et al, (2004) *Muscle Nerve* 30 (2): 131-156), rheumatoid arthritis (Rashid T et al (2007) *Clin Exp Rheumatol* 25 (2): 259-267), rheumatic fever (Guilherme L, Kalil J (2009) *J Clin Immunol*). In one embodiment the computer based analysis system described herein allows characterization of epitope mimics and can be applied to a variety of potential mimic substrates, including but not limited to vaccines, biotherapeutic drugs, food ingredients, to enable prediction of whether an adverse reaction could arise through exposure of an individual to a molecular mimic and which individuals (i.e. comprising which HLA haplotypes) may be most at risk.

HLA haplotypes have been implicated in the epidemiology of a wide array of diseases. For example leukemias (Fernandes et al (2010) Blood Cells Mol Dis), leprosy (Zhang et al, (2009) *N Engl J Med* 361 (27): 2609-2618), multiple sclerosis (Ramagopalan S V et al (2009). *Genome Med* 1 (11): 105), hydatid disease (Yalcin E et al, (2010) *Parasitol Res*), diabetes (Borchers A T et al, (2009) *Autoimmun Rev*), dengue (Stephens H A (2010) *Curr Top Microbiol Immunol* 338 99-114), rheumatoid arthritis (Tobon G J et al, (2010) *J Autoimmun*, S0896-8411) and many allergies ((Raulf-Heimsoth M, et al (2004). *Allergy* 59 (7): 724-733; Quiralte J et al, (2007) *J Investig Allergol Clin Immunol* 17 Suppl 1 24-30; Kim S H et al, (2005). *Clin Exp Allergy* 35 (3): 339-344; Malherbe L (2009) *Ann Allergy Asthma Immunol* 103 (1): 76-79). The present invention may permit better understanding of such linkages and predispositions. In one embodiment, therefore, the invention is used to predict risk of certain adverse disease outcomes. In yet another embodiment the invention can be used to predict individuals sensitive to certain allergens.

C. Epitopes

The present invention provides polypeptides (including proteins) comprising epitopes from a target proteome, portion of a proteome, set or proteins, or protein of interest. In some embodiments, the present invention provides one or more recombinant or synthetic polypeptides comprising one or more epitopes (e.g., B-cell epitopes or T-cell epitopes) from a target proteome, portion of a proteome, set or proteins, or protein of interest. In some embodiments, the polypeptide is from about 4 to about 200 amino acids in length, from about 4 to about 100 amino acids in length, from about 4 to about 50 amino acids in length, or from about 4 to about 35 amino acids in length. In some embodiments, the epitope is a B-cell epitope, whether made up of a single linear sequence or multiple shorter peptide sequences comprising a discontinuous epitope. In some embodiments, the B-cell epitope sequence is from a transmembrane protein having a transmembrane portion. In some embodiments, the B-cell epitope sequence is internal or external to said transmembrane portion of said transmembrane protein. In some embodiments, the B-cell epitope sequence is external to the transmembrane portion of a transmembrane protein and from about 1 to about 20, about 1 to about 10, or from about 1 to about 5 amino acids separate said B-cell epitope sequence from said transmembrane portion. In some embodiments, the B-cell epitope sequence is located in an external loop portion or tail portion of said transmembrane protein. In some embodiments, the external loop portion or tail portion comprises one or no consensus protease cleavage sites. In some embodiments, the B-cell epitope sequence comprises one or more hydrophilic amino acids. In some embodiments, the B-cell epitope sequence has hydrophilic characteristics. In some embodiments, the B-cell epitope sequence is conserved across two or more strains of a particular organism. In some embodiments, the B-cell epitope sequence is conserved across ten or more strains of a particular organism.

In some embodiments, the present invention provides isolated polypeptides comprising one or more peptides that bind to one or more members of an MHC or HLA binding region. In some embodiments, the MHC is MHC I. In some embodiments, the MHC is MHC II. In some embodiments, the peptide that binds to a MHC is external to said transmembrane portion of said transmembrane protein and wherein from about 1 to about 20 amino acids separate said peptide that binds to a MHC from said transmembrane portion. In some embodiments, the peptide that binds to a MHC is located in an external loop portion or tail portion of said transmembrane protein. In some embodiments, the external loop portion or tail portion comprises less than one consensus protease cleavage site. In some embodiments, the external loop portion or tail portion comprises more than one peptide that binds to a MHC. In some embodiments, the peptide that binds to a MHC is located partially in a cell membrane spanning-region and partially in an external loop or tail region of said transmembrane protein. In some embodiments peptides which bind to MHC binding regions may be intracellularly located. In further embodiments the peptide that binds to a MHC may be located intracellularly. In the case of a virus, a peptide which comprises a MHC binding region may be located in a structural protein or a non structural viral protein and may or may not be displayed on the outer surface of a virion, and in an infected cell may be located intracellularly or expressed on the cell surface.

In some embodiments, the peptide that binds to a MHC is from about 4 to about 150 amino acids in length. In some embodiments, the peptide that binds to a MHC is from about 4 to about 25 amino acids in length, and can preferably be either 9 or 15 amino acids in length. In some embodiments, MHC is a human MHC. In some embodiments, the MHC is a mouse MHC. In some embodiments, the peptide that binds to a MHC is conserved across two or more strains of a particular organism. In some embodiments, the peptide that binds to a MHC is conserved across ten or more strains of a particular organism. In some embodiments, the peptide that binds to one or more MHC binding regions has a predicted affinity for at least one MHC binding region of about greater than $10^5$ $M^{-1}$, about greater than $10^6$ $M^{-1}$, about greater than $10^7$ $M^{-1}$, about greater than $10^8$ $M^{-1}$, and about greater than $10^9$ $M^{-1}$. In some preferred embodiments, the predicted affinity is determined by the process described above, and in particular by application of principal components via a neural network.

In some preferred embodiments, the polypeptides comprise both a B-cell epitope and a peptide that binds to one or more members of an MHC or HLA superfamily. In some embodiments, the amino acids encoding said B-cell epitope sequence and said peptide that binds to a MHC overlap.

In some embodiments, the present invention provides compositions comprising a plurality (e.g., 2, 3, 4, 5, 6, 7, 8, 9, 10 or more up to about 50) of the polypeptides described above. Such compositions provide immunogens for multiple loci on a target organism or cell.

In some embodiments, the present invention provides a nucleic acid encoding one or more of the polypeptides described above. In some embodiments, the present invention provides a vector comprising the nucleic acid. In some embodiments, the present invention provides a cell comprising the vector.

In some embodiments, the polypeptides of the present invention are used to make vaccines and antibodies as described in detail below and also to make diagnostic assays. In some embodiments, the systems of the present invention allow for a detailed analysis of the interaction of specific epitopes with specific HLA alleles. Accordingly, the present invention provides vaccines, antibodies and diagnostic assays that are matched to subjects having a particular HLA allele or haplotype. In some embodiments, the polypeptides of the present invention comprise one or more epitopes that bind with a strong affinity to from 1 to 20, 1 to 10, 1 to 5, 1 to 2, 2 or 1 HLA alleles or haplotypes, and that bind with weak affinity to from 1 to 20, 1 to 10, 1 to 5, 1 to 2, 2 or 1 HLA alleles or haplotypes. In some embodiments, the vaccines, antibodies and diagnostic assays of the present invention are matched to a subject having a particular haplotype, wherein the match is determined by the predicted binding affinity of a particular epitope or epitopes to the HLA allele of the subject. In preferred embodiments, the predicted binding affinity is determined as described in detail above.

The processes described above were used to analyze the genomes of organisms listed in Tables 14A and 14B in Example 13. Examples of polypeptides comprising epitopes of from these organisms, and in particular polypeptides comprising predicted B-cell epitope sequences and MHC-binding peptides, are provided in the accompanying SEQ ID Listing (SEQ ID NOs 1-3407292). The SEQ ID NOs are provided in Tables 14A and 14B, which provides a summary of the location of the protein from which the peptide is derived (i.e., membrane, secreted or other) and the binding characteristics of the peptide (B-cell epitope (BEPI) or MHC epitope (TEPI)(MHC-I and MHC-II denote the tenth percentile highest affinity binding; MHC-I top 1% and MHC-II top 1% denote the one percentile highest affinity binding. Sequence numbers correspond to the SEQ ID Listing accompanying the application). Polypeptide sequences containing both B-cell epitopes and T-cell epitopes within a defined area of overlap are readily determinable by mapping the identified epitopes within the source organism. In some embodiments, the present invention provides a polypeptide comprising a first peptide sequence that binds to at least one major histocompatibility complex (MHC) binding region with a predicted affinity of greater than about $10^6$ M$^{-1}$ and a second polypeptide sequence that binds to a B-cell receptor or antibody, wherein the first and second sequences overlap or have borders within about 1 to about 20 amino acids, about 2 to about 20 amino acids, about 3 to about 20 amino acids, about 1 to about 10 amino acids, about 2 to about 10 amino acids, about 3 to about 10 amino acids, about 1 to about 7 amino acids, about 2 to about 7 amino acids, or about 3 to about 7 amino acids.

In some embodiments the polypeptide includes a flanking sequence extending beyond the region comprising the T-cell epitope and/or B-cell epitope sequence. Such a flanking sequence may be used in assuring a synthetic version of the peptide is displayed in such a way as to represent the topological arrangement in its native state. For instance inclusion of a flanking sequence at each end which comprise transmembrane helices (each typically about 20 amino acids) may be used to ensure a protein loop is displayed as an external loop with the flanking transmembrane helices embedded in the membrane (like a croquet hoop). Flanking sequences may be included to allow multiple peptides to be arranged together to epitopes that occur adjacent to each other in a native protein. A flanking sequence may be used to facilitate expression as a fusion polypeptide, for instance linked to an immunoglobulin Fc region to ensure secretion. In such embodiments where flanking regions are included said flanking regions may comprise from 1-20, from 1-50, from 10-20, 20-30 or 40-50 amino acids on either or both of the N terminal end or the C terminal end of the epitope polypeptide. The location of each epitope polypeptide in the native protein may be determined by one of skill in the art by referring to the Genbank coordinate included in the Sequence ID listing as part of the organism name. Otherwise, the flanking sequences can be determined by identifying the polypeptide sequences in the organism by sequence comparison using commercially available programs. In some embodiments, the synthetic polypeptide of the present invention comprises the entire protein of which the polypeptide identified by the specific SEQ ID NUMBER is a part of In some embodiments, the present invention provides sequences that are homologous to the sequences described above. It will be recognized that the sequences described above can be altered, for example by substituting one or more amino acids in the sequences with a different amino acid. The substitutions may be made in the listed sequence or in the flanking regions. Such mutated or variant sequences are within the scope of the invention. The substitutions may be conservative or non-conservative. Accordingly, in some embodiments, the present invention provides polypeptide sequences that share at least 70%, 75%, 80%, 85%, 90%, 95%, 96%, 97%, 98%, or 99% identity with the listed sequence. In some embodiments, the variant sequences have about 1, 2, 3, 4, 5, 6, 7, 8, 9 or 10 amino acid substitutions, or a range of substitutions from about 1 to about 10 substitutions, for example 1-4 substitutions, 2-4 substitutions, 3-5 substitutions, 5-10 substitutions, etc.

D. Vaccines

Vaccines are considered to be the most effective medical intervention (Rappuoli et al. 2002. Science 297:937-939), reducing the burden of infectious diseases which kill millions worldwide. A comprehensive reverse vaccinology approach leading to identification of multiple peptides capable of inducing both antibody and cell mediated responses will allow rational design of vaccines to be achieved more rapidly, more precisely, and to produce more durable protection, while avoiding deleterious cross reactivities. By distilling down the epitope to the minimal effective size, from protein to peptide, we can facilitate engineering of delivery vehicles to display an array of several epitopes, inducing an immunity which poses multiple barriers to escape mutation. Reverse vaccinology, assisted by our invention, has particular potential for controlling emerging pathogens where vaccines or epitope targeting drugs can be designed and implemented based on genome sequences even before in vitro culture systems are worked out.

In some embodiments, the present invention provides a vaccine comprising one or more of the polypeptides which comprise epitopes as described above. As described above, in some embodiments, the vaccines are matched to a subject with a particular haplotype. In some embodiments, the present invention provides compositions comprising one or more of the polypeptides described above and an adjuvant. In some embodiments, the vaccines comprise recombinant or synthetic polypeptides derived from a transmembrane protein from a target cell or organisms that comprises one or more B-cell epitopes and/or peptides that bind to one or more members of an MHC or HLA superfamily. Suitable target cells and organisms include, but are not limited to, prokaryotic and eukaryotic organisms, bacteria, archaea, protozoas, viruses, fungi, helminthes, carcinomas, tumors, cancer cells, etc. as described in detail above.

As used herein, the term "vaccine" refers to any combination of peptides or single peptide formulation. There are various reasons why one might wish to administer a vaccine of a combination of the peptides of the present invention rather than a single peptide. Depending on the particular peptide that one uses, a vaccine might have superior characteristics as far as clinical efficacy, solubility, absorption, stability, toxicity and patient acceptability are concerned. It should be readily apparent to one of ordinary skill in the art how one can formulate a vaccine of any of a number of combinations of peptides of the present invention. There are many strategies for doing so, any one of which may be implemented by routine experimentation.

The peptides of the present invention may be administered as a single agent therapy or in addition to an established therapy, such as inoculation with live, attenuated, or killed virus, or any other therapy known in the art to treat the target disease or epitope-sensitive condition.

The appropriate dosage of the peptides of the invention may depend on a variety of factors. Such factors may include, but are in no way limited to, a patient's physical characteristics (e.g., age, weight, sex), whether the compound is being used as single agent or adjuvant therapy, the type of MHC restriction of the patient, the progression (i.e., pathological state) of the infection or other epitope-sensitive condition, and other factors that may be recognized by one skilled in the art. In general, an epitope or combination of epitopes may be administered to a patient in an amount of from about 50 micrograms to about 5 mg; dosage in an amount of from about 50 micrograms to about 500 micrograms is especially preferred.

In some embodiments, the peptides are expressed on bacteria, such as *lactococcus* and *lactobacillus*, or expressed on virus or virus-like particles for use as vaccines. In some embodiments, the peptides are incorporated into other carriers as are known in the art. For example, in some embodiments, the polypeptides comprising one or more epitopes are conjugated or otherwise attached to a carrier protein. Suitable carrier proteins include, but are not limited to keyhole limpet hemocyanin, bovine serum albumin, ovalbumin, and thyroglobulin. In yet other embodiments the polypeptide may be fused to an Fc region of an immunoglobulin for delivery to a mucosal site bearing corresponding receptors.

One may administer a vaccine of the present invention by any suitable method, which may include, but is not limited to, systemic injections (e.g., subcutaneous injection, intradermal injection, intramuscular injection, intravenous infusion) mucosal administrations (e.g., nasal, ocular, oral, vaginal and anal formulations), topical administration (e.g., patch delivery), or by any other pharmacologically appropriate technique. Vaccination protocols using a spray, drop, aerosol, gel or sweet formulation are particularly attractive and may be also used. The vaccine may be administered for delivery at a particular time interval, or may be suitable for a single administration.

Vaccines of the invention may be prepared by combining at least one peptide with a pharmaceutically acceptable liquid carrier, a finely divided solid carrier, or both. As used herein, "pharmaceutically acceptable carrier" refers to a carrier that is compatible with the other ingredients of the formulation and is not toxic to the subjects to whom it is administered. Suitable such carriers may include, for example, water, alcohols, natural or hardened oils and waxes, calcium and sodium carbonates, calcium phosphate, kaolin, talc, lactose, combinations thereof and any other suitable carrier as will be recognized by one of skill in the art. In a most preferred embodiment, the carrier is present in an amount of from about 10 uL (micro-Liter) to about 100 uL.

In some embodiments, the vaccine composition includes an adjuvant. Examples of adjuvants include, but are not limited to, mineral salts (e.g., aluminum hydroxide and aluminum or calcium phosphate gels); oil emulsions and surfactant based formulations (e.g., MF59 (microfluidized detergent stabilized oil-in-water emulsion), QS21 (purified saponin), Ribi Adjuvant Systems, AS02 [SBAS2] (oil-in-water emulsion+MPL+QS-21), Montanide ISA-51 and ISA-720 (stabilized water-in-oil emulsion); particulate adjuvants (e.g., virosomes (unilamellar liposomal vehicles incorporating influenza haemagglutinin), AS04 ([SBAS4] Al salt with MPL), ISCOMS (structured complex of saponins and lipids), polylactide co-glycolide (PLG); microbial derivatives (natural and synthetic), e.g., monophosphoryl lipid A (MPL), Detox (MPL+*M. Phlei* cell wall skeleton), AGP [RC-529] (synthetic acylated monosaccharide), DC Chol (lipoidal immunostimulators able to self organize into liposomes), OM-174 (lipid A derivative), CpG motifs (synthetic oligonucleotides containing immunostimulatory CpG motifs), modified LT and CT (genetically modified bacterial toxins to provide non-toxic adjuvant effects); endogenous human immunomodulators (e.g., hGM-CSF or hIL-12 (cytokines that can be administered either as protein or plasmid encoded), Immudaptin (C3d tandem array); and inert vehicles, such as gold particles. In various embodiments, vaccines according to the invention may be combined with one or more additional components that are typical of pharmaceutical formulations such as vaccines, and can be identified and incorporated into the compositions of the present invention by routine experimentation. Such additional components may include, but are in no way limited to, excipients such as the following: preservatives, such as ethyl-p-hydroxybenzoate; suspending agents such as methyl cellulose, tragacanth, and sodium alginate; wetting agents such as lecithin, polyoxyethylene stearate, and polyoxyethylene sorbitan mono-oleate; granulating and disintegrating agents such as starch and alginic acid; binding agents such as starch, gelatin, and acacia; lubricating agents such as magnesium stearate, stearic acid, and talc; flavoring and coloring agents; and any other excipient conventionally added to pharmaceutical formulations.

Further, in various embodiments, vaccines according to the invention may be combined with one or more of the group consisting of a vehicle, an additive, a pharmaceutical adjunct, a therapeutic compound or agent useful in the treatment of the desired disease, and combinations thereof.

In another aspect of the present invention, a method of creating a vaccine is provided. The method may include identifying an immunogenic epitope; synthesizing a peptide epitope from the immunogenic epitope; and creating a composition that includes the peptide epitope in a pharmaceutical carrier. The composition may have characteristics similar to the compositions described above in accordance with alternate embodiments of the present invention. Accordingly, the present invention provides vaccines and therapies for a variety of infections and clinical conditions. These infections and conditions include, but are not limited to, Mediterranean fever, undulant fever, Malta fever, contagious abortion, epizootic abortion, Bang's disease, *Salmonella* food poisoning, enteric paratyphosis, Bacillary dysentery, *Pseudotuberculosis*, plague, pestilential fever, Tuberculosis, Vibrios, Circling disease, Weil's disease, Hemorrhagic jaundice (Leptospira icterohaemorrhagiae), canicola fever (*L. canicola*), dairy worker fever (L. hardjo), Relapsing fever, tick-borne relapsing fever, spirochetal fever, vagabond fever, famine fever, Lyme arthritis, Bannworth's syndrome, tick-borne meningopolyneuritis, erythema chronicum migrans, Vibriosis, Colibacteriosis, colitoxemia, white scours, gut edema of swine, enteric paratyphosis, *Staphylococcal* alimentary toxicosis, *staphylococcal* gastroenteritis, Canine Corona Virus (CCV) or canine parvovirus enteritis, feline infectious peritonitis virus, transmissible gastroenteritis (TGE) virus, Hagerman Redmouth Disease (ERMD), Infectious Hematopoietic necrosis (IHN), porcine *Actinobacillus* (*Haemophilus*) pleuropneumonia, Hansen's disease, Streptotrichosis, Mycotic Dermatitis of Sheep, Pseudoglanders, Whitmore's disease, Francis' disease, deer-fly fever, rabbit fever, O'Hara disease, Streptobacillary fever, Haverhill fever, epidemic arthritic erythema, sodoku, Shipping or transport fever, hemorrhagic septicemia, Ornithosis, Parrot Fever, Chlamydiosis, North American blastomycosis, Chicago disease, Gilchrist's disease, Cat Scratch Fever, Benign Lymphoreticulosis, Benign nonbacterial Lymphadenitis, Bacillary Angiomatosis, Bacillary Peliosis Hepatitis, Query fever, Balkan influenza, Balkan grippe, abattoir fever, Tick-borne fever, pneumorickettsiosis, American Tick Typhus, Tick-borne Typhus Fever, Vesicular Rickettsiosis, Kew Gardens Spotted Fever, Flea-borne Typhus Fever, Endemic Typhus Fever, Urban Typhus, Ringworm, Dermatophytosis, Tinea, Trichophytosis, Microsporosis, Jock Itch, Athlete's Foot, *Sporothrix schenckii*, dimorphic fungus, Cryptococcosis and histoplasmosis, Benign Epidermal Monkeypox, Herpesvirus *simiae*, Simian B Disease, Type C lethargic encephalitis, Yellow fever, Black Vomit, hantavirus pulmonary syndrome, Korean Hemorrhagic Fever, Nephropathia Epidemica, Epidemic Hemorrhagic Fever, Hemorrhagic Nephrosonephritis, lymphocytic choriomeningitis, California encephalitis/La Crosse encephalitis, African Hemorrhagic Fever, Green or Vervet Monkey Disease, Hydrophobia, Lyssa, Infectious hepatitis, Epidemic hepatitis, Epidemic jaundice, Rubeola, Morbilli, Swine and Equine Influenza, Fowl Plague, Newcastle disease, Piroplasmosis, toxoplasmosis, African Sleeping Sickness, Gambian Trypanosomiasis, Rhodesian Trypanosomiasis, Chagas's Disease, Chagas-Mazza Disease, South American Trypanosomiasis, *Entamoeba histolytica*, Balantidial dysentery, cryptosporidiosis, giardiasis, Cutaneous leishmaniasis; Bagdad boil, Delhi boil, Bauru ulcer, Visceral leishmaniasis: kala-azar, Microsporidiosis, Anisakiasis, Trichinosis, Angiostrongylosis, eosinophilic meningitis or meningoencephalitis (*A. cantonensis*), abdominal angiostrongylosis (*A. costaricensis*), Uncinariasis, Necatoriasis, Hookworm Disease, Capillariasis, Brugiasis, Toxocariasis, Oesophagostomiasis, Strongyloidiasis, Trichostrongylosis, Ascaridiasis, Diphyllobothriasis, Sparganosis, Hydatidosis, Hydatid Disease, *Echinococcus granulosis*, Cystic hydatid disease, Tapeworm Infection, Schistosomiasis and the like. Malignant diseases caused by infectious pathogens are contemplated as well. The examples of such diseases include for example Burkitt's lymphoma caused by EBV, Rous sarcoma caused by Rous retrovirus, Kaposi' sarcoma caused by herpes virus type 8, adult T-cell leukemia caused by HTLV-I retrovirus, or hairy cell leukemia caused by HTLV-II, and many other tumors and leukemias caused by infectious agents and viruses. Further it may provide vaccines and therapies for emerging diseases yet to be defined, whether emerging from natural reservoirs or resulting from exposure to genetically engineered bioterror organisms.

In still further embodiments, the present invention provides vaccine compositions for treatment of cancer. In some embodiments, the vaccines comprise recombinant or synthetic polypeptides from a transmembrane protein from a cancer cell that comprises one or more B-cell epitopes and/or peptides that bind to one or more members of an MHC or HLA superfamily. The polypeptides are identified as described above. In some embodiments, the polypeptides are attached to a carrier protein and/or used in conjunction with an adjuvant. Examples of can that can be treated include, but are not limited to, bladder carcinomas, breast carcinomas, colon carcinomas, kidney carcinomas, liver carcinomas, lung carcinomas, including small cell lung cancer, esophagus carcinomas, gall-bladder carcinomas, ovary carcinomas, pancreas carcinomas, stomach carcinomas, cervix carcinomas, thyroid carcinomas, prostate carcinomas, and skin carcinomas, including squamous cell carcinoma and basal cell carcinoma; hematopoietic tumors of lymphoid lineage, including leukemia, acute lymphocytic leukemia, acute lymphoblastic leukemia, B-cell lymphoma, T-cell-lymphoma, Hodgkin's lymphoma, non-Hodgkin's lymphoma, hairy cell lymphoma and Burkett's lymphoma; hematopoietic tumors of myeloid lineage, including acute and chronic myclogenous leukemias, myelodysplastic syndrome and promyelocytic leukemia; tumors of mesenchymal origin, including fibrosarcoma and rhabdomyosarcoma; tumors of the central and peripheral nervous system, including astrocytoma, neuroblastoma, glioma and schwannomas; and other tumors, including melanoma, seminoma, teratocarcinoma, osteosarcoma, xeroderma pigmentosum, keratoxanthoma, thyroid follicular cancer and Kaposi's sarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, leiomyosarcoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma.

In another embodiment the present invention provides therapies for a variety of autoimmune diseases which may include but are not limited to Ankylosing Spondylitis, Atopic allergy, Atopic Dermatitis, Autoimmune cardiomyopathy, Autoimmune enteropathy, Autoimmune hemolytic anemia, Autoimmune hepatitis, Autoimmune inner ear disease, Autoimmune lymphoproliferative syndrome, Autoimmune peripheral neuropathy, Autoimmune pancreatitis, Autoimmune polyendocrine syndrome, Autoimmune progesterone dermatitis, Autoimmune thrombocytopenic purpura, Autoimmune uveitis, Bullous Pemphigoid, Castleman's disease, Celiac disease, Cogan syndrome, Cold agglutinin disease, Crohns Disease, Dermatomyositis, Diabetes mellitus type 1, Eosinophilic fasciitis, Gastrointestinal pemphigoid, Goodpasture's syndrome, Graves' disease, Guillain-Barr-syndrome, Anti-ganglioside Hashimoto's encephalitis, Hashimoto's thyroiditis, Systemic Lupus erythematosus, Miller-Fisher syndrome, Mixed Connective Tissue Disease, Myasthenia gravis, Narcolepsy, Pemphigus vulgaris, Polymyositis, Primary biliary cirrhosis, Psoriasis, Psoriatic Arthritis, Relapsing polychondritis, Rheumatoid arthritis, Sjögren's syndrome, Temporal arteritis, Ulcerative Colitis, Vasculitis, and Wegener's granulomatosis.

E. Antibodies

In some embodiments, the present invention provides for the development of antigen binding proteins (e.g., antibodies or fragments thereof) that bind to a polypeptide as described above. Monoclonal antibodies are preferably prepared by methods known in the art, including production of hybridomas, use of humanized mice, combinatorial display techniques, and the like. See, e.g., of Kohler and Milstein, Nature, 256:495 (1975), Wood et al., WO 91/00906, Kucherlapati et al., WO 91/10741; Lonberg et al., WO 92/03918; Kay et al., WO 92/03917 [each of which is herein incorporated by reference in its entirety]; N. Lonberg et al., Nature, 368:856-859 [1994]; L. L. Green et al., Nature Genet., 7:13-21 [1994]; S. L. Morrison et al., Proc. Nat. Acad. Sci. USA, 81:6851-6855 [1994]; Bruggeman et al., Immunol., 7:33-40 [1993]; Tuaillon et al., Proc. Nat. Acad. Sci. USA, 90:3720-3724 [1993]; and Bruggeman et al. Eur. J. Immunol., 21:1323-1326 [1991]); Sastry et al., Proc. Nat. Acad. Sci. USA, 86:5728 [1989]; Huse et al., Science, 246:1275 [1989]; and Orlandi et al., Proc. Nat. Acad. Sci. USA, 86:3833 [1989]); U.S. Pat. No. 5,223,409; WO 92/18619; WO 91/17271; WO 92/20791; WO 92/15679; WO 93/01288; WO 92/01047; WO 92/09690; WO 90/02809 [each of which is herein incorporated by reference in its entirety]; Fuchs et al., Biol. Technology, 9:1370-1372 [1991]; Hay et al., Hum. Antibod. Hybridomas, 3:81-85 [1992]; Huse et al., Science, 46:1275-1281 [1989]; Hawkins et al., J. Mol. Biol., 226:889-896 [1992]; Clackson et al., Nature, 352:624-628 [1991]; Gram et al., Proc. Nat. Acad. Sci. USA, 89:3576-3580 [1992]; Garrad et al., Bio/Technolog, 2:1373-1377 [1991]; Hoogenboom et al., Nuc. Acid Res., 19:4133-4137 [1991]; and Barbas et al., Proc. Nat. Acad. Sci. USA, 88:7978 [1991].

The antigen binding proteins of the present invention include chimeric and humanized antibodies and fragments thereof, including scFv's. (See e.g., Robinson et al., PCT/US86/02269; European Patent Application 184,187; European Patent Application 171,496; European Patent Application 173,494; WO 86/01533; U.S. Pat. No. 4,816,567; European Patent Application 125,023 [each of which is herein incorporated by reference in its entirety]; Better et al., Science, 240:1041-1043 [1988]; Liu et al., Proc. Nat. Acad. Sci. USA, 84:3439-3443 [1987]; Liu et al., J. Immunol., 139:3521-3526 [1987]; Sun et al., Proc. Nat. Acad. Sci. USA, 84:214-218 [1987]; Nishimura et al., Canc. Res., 47:999-1005 [1987]; Wood et al., Nature, 314:446-449 [1985]; and Shaw et al., J. Natl. Cancer Inst., 80:1553-1559 [1988]), U.S. Pat. No. 5,225,539 (incorporated herein by reference in its entirety); Jones et al., Nature, 321:552-525 [1986]; Verhoeyan et al., Science, 239:1534 [1988]; and Beidler et al., J. Immunol., 141:4053 [1988]).

In some embodiments, the present invention provides fusion proteins comprising an antibody or fragment thereof fused to an accessory polypeptide of interest, for example, an enzyme, antimicrobial polypeptide, or fluorescent polypeptide. In preferred embodiments, the fusion proteins include a monoclonal antibody subunit (e.g., a human, murine, or bovine), or a fragment thereof, (e.g., an antigen binding fragment thereof). In some embodiments, the accessory polypeptide is a cytotoxic polypeptide or agent (e.g., lysozyme, cathelicidin, PLA2, and the like). See, e.g., U.S. patent application Ser. Nos. 10/844,837; 11/545,601; 12/536,291; and Ser. No. 11/254,500; each of which is incorporated herein by reference.

In some preferred embodiments, the monoclonal antibody is a murine antibody or a fragment thereof. In other preferred embodiments, the monoclonal antibody is a bovine antibody or a fragment thereof. For example, the murine antibody can be produced by a hybridoma that includes a B-cell obtained from a transgenic mouse having a genome comprising a heavy chain transgene and a light chain transgene fused to an immortalized cell. In some embodiments, the antibody is humanized. The antibodies can be of various isotypes, including, but not limited to: IgG (e.g., IgG1, IgG2, IgG2a, IgG2b, IgG2c, IgG3, IgG4); IgM; IgA1; IgA2; IgAsec; IgD; and IgE. In some preferred embodiments, the antibody is an IgG isotype. In other preferred embodiments, the antibody is an IgM isotype. The antibodies can be full-length (e.g., an IgG1, IgG2, IgG3, or IgG4 antibody) or can include only an antigen-binding portion (e.g., a Fab, F(ab')2, Fv or a single chain Fv fragment).

In preferred embodiments, the immunoglobulin subunit of the fusion proteins is a recombinant antibody (e.g., a chimeric or a humanized antibody), a subunit, or an antigen binding fragment thereof (e.g., has a variable region, or at least a CDR).

In preferred embodiments, the immunoglobulin subunit of the fusion protein is monovalent (e.g., includes one pair of heavy and light chains, or antigen binding portions thereof). In other embodiments, the immunoglobulin subunit of the fusion protein is a divalent (e.g., includes two pairs of heavy and light chains, or antigen binding portions thereof). In preferred embodiments, the transgenic fusion proteins include an immunoglobulin heavy chain or a fragment thereof (e.g., an antigen binding fragment thereof).

In some embodiments, the present invention provides antibodies (or portions thereof) fused to biocidal molecules (e.g., lysozyme) (or portions thereof) suitable for use with processed food products as a whey based coating applied to food packaging and/or as a food additive. In still other embodiments, the compositions of the present invention are formulated for use as disinfectants for use in food processing facilities. Additional embodiments of the present invention provide human and animal therapeutics.

The present invention also provides for the design of immunogens to raise antibodies for passive immune therapies in addition to use of the fusion antibodies described above. Passive antibodies have long been applied as therapeutics. Some of the earliest methods to treat infectious disease comprised the use of "immune sera" (e.g., diphtheria antitoxin developed in the 1890s. With newer methods to reduce immune responses to the antibodies thus supplied the concept of passive immunity and therapeutic antibody administration is receiving renewed interest for infectious diseases (Casadevall, *Nature Reviews Microbiology* 2, 695-703 (September 2004).

Accordingly, in some embodiments, the antibodies developed from epitopes identified by the present invention find use passive antibody therapies. In some embodiments, the antibodies of the present invention are administered to a subject to treat a disease or condition. In some embodiments, the antibodies are administered to treat a subject suffering from an acute infection exposure to a toxin. In some embodiments, the antibodies are administered prophylactically, for example, to treat an immunodeficiency disease.

The antibodies developed from epitopes identified by the present invention may be administered by a variety of routes. In some embodiments, the antibodies are administered intravenously, while in other embodiments, the antibodies are administered orally or intramuscularly. In some preferred embodiments, the antibodies used for therapeutic purposes are humanized antibodies.

In some embodiments, the antibody is conjugated to a therapeutic agent. Therapeutic agents include, for example but not limited to, chemotherapeutic drugs such as vinca alkaloids and other alkaloids, anthracyclines, epidophyllotoxins, taxanes, antimetabolites, alkylating agents, antibiotics, COX-2 inhibitors, antimitotics, antiangiogenic and apoptotoic agents, particularly doxorubicin, methotrexate, taxol, CPT-11, camptothecans, and others from these and other classes of anticancer agents, and the like. Other useful cancer chemotherapeutic drugs for the preparation of immunoconjugates and antibody fusion proteins include nitrogen mustards, alkyl sulfonates, nitrosoureas, triazenes, oxaliplatin, folic acid analogs, COX-2 inhibitors, pyrimidine analogs, purine analogs, platinum coordination complexes, hormones, toxins (e.g., RNAse, *Pseudomonas* exotoxin), and the like. Other suitable chemotherapeutic agents, such as experimental drugs, are known to those of skill in the art. In some embodiments, the antibody is conjugated to a radionuclide.

F. Diagnostics

The polypeptides and antibodies of the present invention may be used in a number of assay formats, including, but not limited to, radio-immunoassays, ELISAs (enzyme linked immunosorbant assay), "sandwich" immunoassays, immunoradiometric assays, immunofluorescence assays, and immunoelectrophoresis assays. (See e.g., U.S. Pat. Nos. 5,958,715, and 5,484,707, 4,703,017; 4,743,560; 5,073,48; 4,246,339; 4,277,560; 4,632,901; 4,812,293; 4,920,046; and 5,279,935; 5,229,073; 5,591,645; 4,168,146; 4,366,241; 4,855,240; 4,861,711; 4,703,017; 5,451,504; 5,451,507; 5,798,273; 6,001,658; and 5,120,643; European Patent No. 0296724; WO 97/06439; and WO 98/36278 and U.S. Patent Application Publication Nos. 20030049857 and 20040241876, U.S. Pat. No. 6,197,599, WO 90/05305, U.S. Pat. No. 6,294,790 and U.S. Patent Application US20010014461A1, each of which is herein incorporated by reference). In some embodiments, the polypeptides and antibodies are conjugated to a hapten or signal generating molecule. Suitable haptens include, but are not limited to, biotin, 2,4-Dintropheyl, Fluorescein deratives (FITC, TAMRA, Tex. Red, etc.) and Digoxygenin. Suitable signal generating molecules include, but are not limited to, fluorescent molecules, enzymes, radionuclides, and agents such as colloidal gold. Numerous fluorochromes are known to those of skill in the art, and can be selected, for example from Invitrogen, e.g., see, The Handbook—A Guide to Fluorescent Probes and Labeling Technologies, Invitrogen Detection Technologies, Molecular Probes, Eugene, Oreg.).

Enzymes useful in the present invention include, for example, horseradish peroxidase, alkaline phosphatase, acid phosphatase, glucose oxidase, β-galactosidase, β-glucuronidase or β-lactamase. Where the detectable label includes an enzyme, a chromogen, fluorogenic compound, or luminogenic compound can be used in combination with the enzyme to generate a detectable signal (numerous of such compounds are commercially available, for example, from Invitrogen Corporation, Eugene Oreg.).

G. Applications

The method of the present invention are useful for a wide variety of applications, including but not limited to, the design and development of vaccines, biotherapeutic antigen binding proteins, diagnostic antigen binding proteins, and biotherapeutic proteins.

In some embodiments, the methods of the present invention are used to identify peptides that bind to one or more MHC or HLA binding regions. This application is highly useful in the development, design and evaluation of vaccines and the polypeptides included in the vaccine that are intended to initiate an immune response. In some embodiments, the methods of the present invention allow for the determination of the predicted binding affinities of one or more MHC binding regions for polypeptide(s)(and the epitopes contained therein) that is included in a vaccine or is a candidate for inclusion in a vaccine. Application of these methods identifies epitopes that are bound by particular MHC binding regions with high affinity, but at only low affinity by other MHC binding regions. Thus, the effectiveness of the epitopes for vaccination of population, subpopulation or individual with a particular haplotype can be determined. Thus, the processes of the present invention allow identification of populations or individuals that are predicted to be more or less responsive to the vaccine. If desired, the vaccine can then be designed to target a subset of the population with particular MHC binding regions or be designed to provide an immunogenic response in a high percentage of subjects within a population or subpopulation, for example, greater than 50%, 60%, 70%, 80%, 90%, 95% or 99% of all subjects within a population or subpopulation. The present invention therefore facilitates design of vaccines with selected polypeptides with a predicted binding affinity for MHC binding regions, and thus which are designed to elicit an immune response in defined populations (e.g., subpopulations or the entire population or a desired/target percentage of the population).

These methods are particularly applicable to the design of subunit vaccines that comprise isolated polypeptides. In some embodiments, polypeptides selected for a vaccine bind to one or more MHC binding regions with a predicted affinity for at least one MHC binding region of about greater than $10^5$ M$^{-1}$, about greater than $10^6$ M$^{-1}$, about greater than $10^7$ M$^{-1}$, about greater than $10^8$ M$^{-1}$, or about greater than $10^9$ M$^{-1}$. In some embodiments, these binding affinities are achieved for about 1% to 5%, 5% to 10%, 10% to 50%, 50% to 100%, 75% to 100% or 90% to 100% or greater than 90%, 95%, 98%, or 99% of subjects within a population or subpopulation.

It is also contemplated that different microorganism strains, viral strains or protein isotypes will vary in their ability to elicit immune responses from subjects with particular binding regions. Accordingly, the methods of the present invention are useful for selecting particular microorganism strains, viral strains or protein isotypes that are including in a vaccine. As above, the methods of the present invention allow for the determination of the predicted binding affinities of one or more MHC binding regions for epitopes contained in the proteome of an organism or protein isotype that are included vaccine or are candidates for inclusion in a vaccine. Application of these methods identifies epitopes that are bound by particular MHC binding regions with high affinity, but at only low affinity by other MHC binding regions. This process allows identification of populations or individuals that are predicted to be more or less responsive to the vaccine. If desired, the vaccine can then be designed to target a subset of the population with particular MHC binding regions or be designed to provide coverage of a high percentage of subjects within a population or subpopulation, for example, greater than 50%, 60%, 70%, 80%, 90%, 95% or 99% of all MHC subjects within a population or subpopulation. The present invention therefore facilitates design of vaccines with selected strains of an organism or virus or protein isotype, and thus which are designed to elicit an immune response in defined populations (e.g., subpopulations or the entire population or a desired/target percentage of the population). In some embodiments, strains of an organism or virus or protein isotype selected for a vaccine bind to one or more MHC binding regions with a predicted affinity for at least one MHC binding region of about greater than $10^5$ $M^{-1}$, about greater than $10^6$ $M^{-1}$, about greater than $10^7$ $M^{-1}$, about greater than $10^8 M^{-1}$, or about greater than $10^9 M^{-1}$. In some embodiments, these binding affinities are achieved for from one individual to about 1% to 5%, 5% to 10%, 10% to 50%, 50% to 100%, 75% to 100% or 90% to 100% or greater than 70%, 80%, 90%, 95%, 98%, 99%, 99.5% or 99.9% of subjects within a defined population or defined subpopulation.

Accordingly, these methods are particularly applicable to the development, design and/or production of therapeutic vaccines. In some embodiments, vaccines are designed to optimize the response of an individual patient of known MHC allotype. In these embodiments, the vaccine is designed to include epitopes that have a high predicted binding affinity for one or more MHC alleles in a subject. For example, in some embodiments, the vaccine comprises 1, 2, 3, 4, 5, 10 or 20 peptides with a predicted affinity for at least one MHC binding region of about greater than $10^5$ $M^{-1}$, about greater than $10^6$ $M^{-1}$, about greater than $10^7$ $M^{-1}$, about greater than $10^8$ $M^{-1}$, or about greater than $10^9$ $M^{-1}$. In some embodiments, the epitope is immunogenic for subjects whose HLA alleles are drawn from a group comprising 1, 5, 10 or 20 or more different HLA alleles. In some embodiments, the epitope is selected to be immunogenic for the HLA allelic composition of an individual patient.

In related embodiments, the present invention also provides methods for identifying a combination of amino acid subsets and MHC binding partners which predispose a subject to a disease outcome, such as an autoimmune response or adverse response to a vaccine, such as anaphylaxis, seizure, coma, brain damage, severe allergic reaction, nervous system impairment, Guillain-Barr-Syndrome, etc. In some embodiments, the present invention provides methods for screening a population to identify individuals with a HLA haplotype which predisposes individuals with the HLA haplotype to a disease outcome. Accordingly such information may be utilized in planning the design of clinical trials to ensure the patient population is representative of all relevant HLAs and does not unnecessarily include high risk individuals.

In some embodiments, the methods of the present invention are useful for identifying the present of peptide mimics in vaccines and biotherapeutics. The methods present invention can therefore be used to design and develop vaccines and biotherapeutics that are substantially free of polypeptide sequences that can elicit unwanted immune responses (e.g., either B cell or T cell responses) that limit the applicability of the vaccine or biotherapeutic due to adverse immune responses in a subject. In some embodiments, protein sequences that are included in existing or proposed vaccines or biotherapeutics are analyzed by the methods disclosed herein to identify epitope mimics. The protein sequences that contain the epitope mimics can then be deleted or modified as necessary, or variant proteins that do not contain the epitope mimic can be selected for the vaccine or biotherapeutic. In some embodiments, removal or modification of the mimic is not possible or desired, the methods of the present invention can be used to identify subpopulations of subjects with MHC binding regions with low predicted binding affinities for the mimics. This information can be used to determine which subset of the patient population the vaccine or biotherapeutic can be administered to without eliciting an unwanted immune response. Thus, the present invention provides methods of identifying a patient subpopulation to which a vaccine or biotherapeutic can be administered.

EXAMPLES

To examine whether the predictions of B-cell epitope and MHC binding affinities and epitope location, derived from the computer based analytical process described herein, were correlated with data from experimental characterization of epitopes described in the scientific literature, we conducted a number of analyses as described below. In some cases, particularly for publications preceding widespread genomic sequencing, the amino acid numbering in the papers are at odds with genome curations. Where discrepancies existed, the curated genomic numbering system was adopted and amino acid residue positions cited in publications were shifted appropriately. This is noted in the text.

Example 1

Correlation with Experimental Data for Certain *Staphylococcus aureus* Surface Proteins A. Thermonuclease (Nase) SA00228-1 NC_002951.57650135

Thermonuclease, also called Nase or micrococcal nuclease, is highly immunogenic and has been the subject of numerous studies. We examined the output of three such publications, cited in detail below. This is an example of different potential confusion in epitope mapping because of different numbering systems. Genetic maps of Nase molecule (Shortie D (1983) *Gene* 22 (2-3): 181-189) indicate three potential initiation sites, the longest of which would produce a protein of 228 amino acids. The work of Schaeffer et al (Schaeffer E B et al (1989) *Proc Natl Acad Sci USA* 86 (12): 4649-4653) indicate the protein (obtained commercially for their experiments) is comprised of 149 amino acids. Careful examination suggests of the gene mapping indicates that amino acid 80 (alanine) in the genomic curation (not residue 61 as found in the genomic curations) equates to residue 1 in the experimental epitope mapping.

Figure 13:
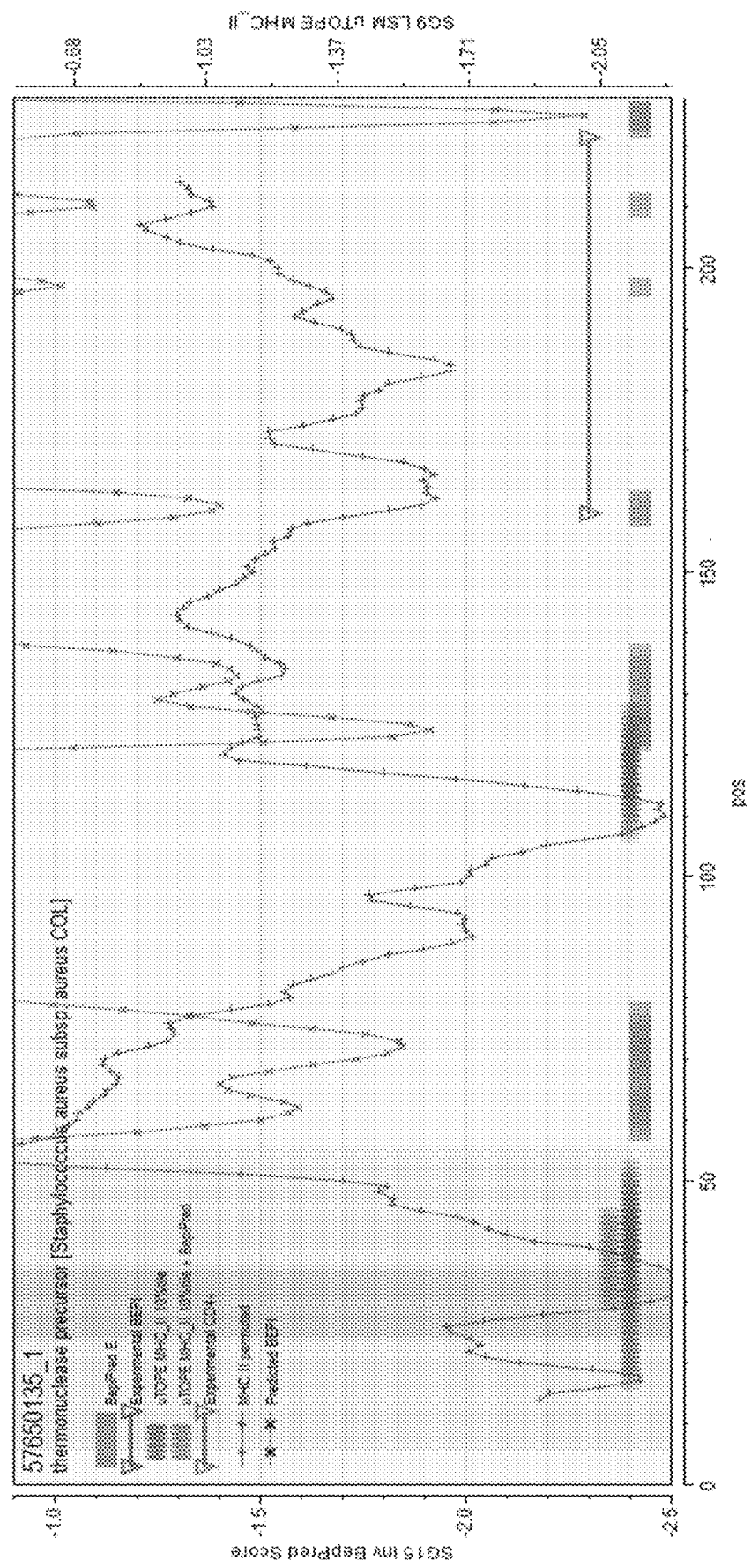
FIG. 13. Overlay of different metrics showing predicted epitope locations and cellular topologies for Thermonuclease (Nase; SA00228-1 NC_002951.57650135). Colored bars represent areas of predicted B-cell epitope sequences (orange), MHC-II (blue), coincident MHC-II and B-cell epitope sequences (green) as indicated in the legend inset. The lines with triangular ends are regions of the protein with experimentally mapped B-cell epitopes (red, below predictions) and CD4 T-cell stimulatory regions indicative sources of peptides bound to the MHC-II (green, above predictions). The background semi-transparent colored shading indicate the different protein topologies for signal peptide (white), extracellular (yellow), transmembrane (green) and intracellular (fuchsia).

A variety of epitope peptides of differing length and overlapping to varying degrees have been mapped in Nase by MHC binding. The region where MHC binding is mapped extends from about amino acid 155 and extends to about amino acid 220 (based on curated numbering system). We examined the experimental work described in three published papers, detailed below. In FIG. 1 the overlapping peptides identified in the papers as binding sites are indicated by dense horizontal arrows and the vertical arrows indicate specific mutations that were done to experimentally define the region. In FIG. 13, immediately underneath the arrows which indicate published results, we show the output of the computer-based analysis in this invention as colored bars.

Proc Natl Acad Sci USA. 1989 June; 86(12):4649-53. Relative contribution of "determinant selection" and "holes in the T-cell repertoire" to T-cell responses. Schaeffer E B, Sette A, Johnson D L, Bekoff M C, Smith J A, Grey H M, Buus S. This study demonstrated epitopes binding to 4 MHC II binding regions in amino acid positions 81-140 (post-cleavage protein; i.e. amino acids 160-219 based on the appropriately revised numbering system).

Cell Immunol. 1996 Sep. 15; 172(2):254-61. The immunodominant region of Staphylococcal nuclease is represented by multiple peptide sequences. Nikcevich K M, Kopielski D, Finnegan A. Nikcevich et al mapped epitopes to the region of amino acids 81-100 (161-180 genomic).

J Immunol. 1993 Aug. 15; 151(4):1852-8. Immunodominance: a single amino acid substitution within an antigenic site alters intramolecular selection of T-cell determinants. Liu Z, Williams K P, Chang Y H, Smith J A. Liu et al mapped regions from 81-100 (161-180) and 112-130 (192-210) murine H-2k MHC II binding sites.

B. *Staphylococcal* Enterotoxin B SA00266-0 NC_002951.57651597 Enterotoxin B (SEB)

Figure 14:
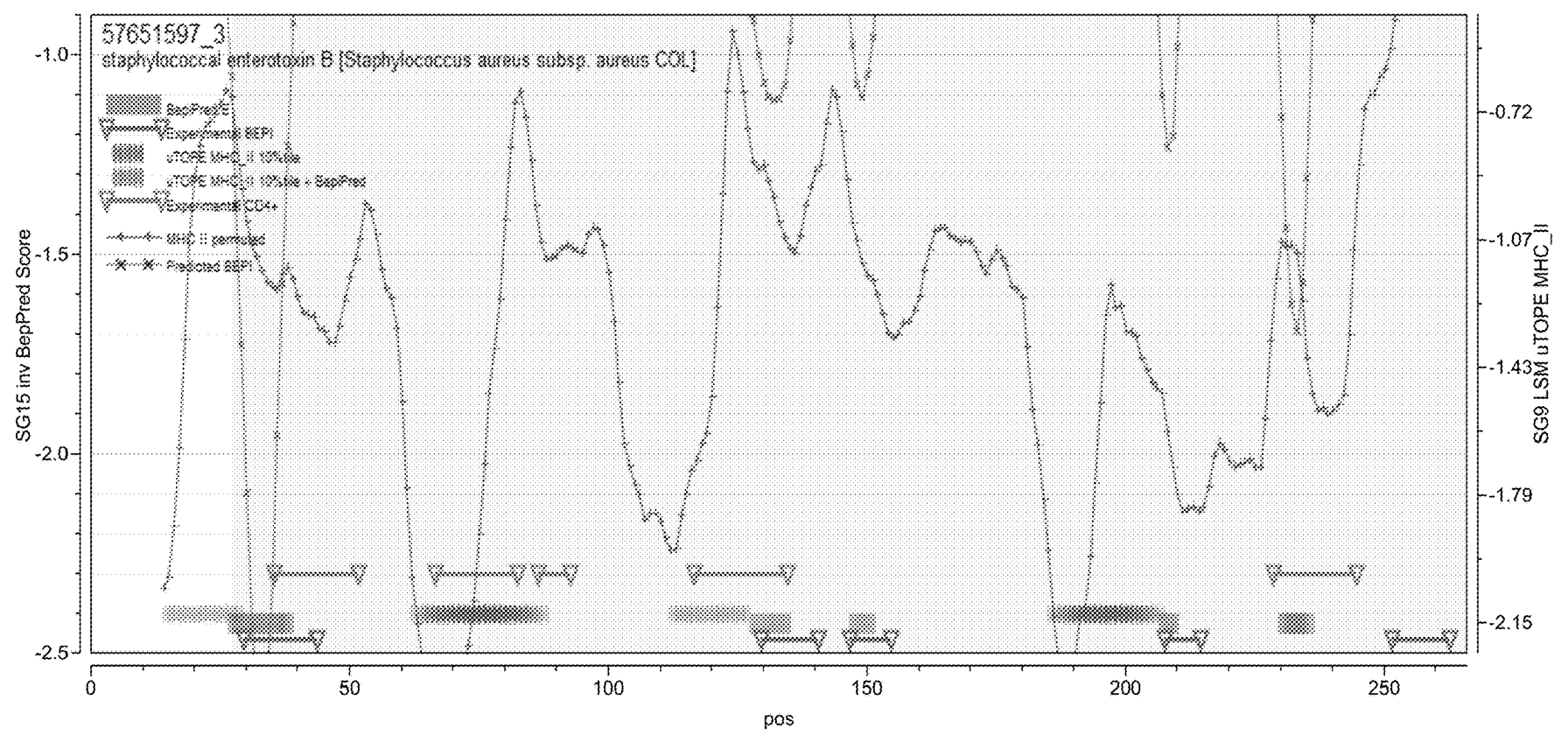

*Staphylococcal* enterotoxin B is the cause of disease and is highly immunogenic. A number of studies have mapped both MHC binding regions, T-Cell receptor interacting regions and antibody (B-cell epitope) regions within the molecule. We examined three such published studies, detailed below. The dense horizontal arrows in FIG. 14 delineate the regions identified in these studies. The amino acid indices in the papers must be adjusted for the cleavage of the signal peptide to match the intact molecule in Genbank.

J Exp Med. 1992 Feb. 1; 175(2):387-96. Mutations defining functional regions of the superantigen *staphylococcal* enterotoxin B. Kappler J W, Herman A, Clements J, Marrack P. Kappler et al identify MHC2 binding regions at positions 37-51 based on numbering system prior to cleavage of the signal peptide (corresponding to positions 9-23 of cleaved protein) and MHC2 binding regions at positions 69-81 (41-53 post cleavage).

FEMS Immunol Med Microbiol. 1997 January; 17(1):1-10. Identification of antigenic sites on *staphylococcal* enterotoxin B and toxoid. Wood A C, Chadwick J S, Brehm R S, Todd I, Arbuthnott J P, Tranter H S. Woods et al identify 3 B-cell epitopes which in two cases we also predict to overlap with MHC binding regions.

J Immunol. 1997 Jan. 1; 158(1):247-54. B-cell epitope mapping of the bacterial superantigen *staphylococcal* enterotoxin B: the dominant epitope region recognized by intravenous IgG. Nishi J I, Kanekura S, Takei S, Kitajima I, Nakajima T, Wahid M R, Masuda K, Yoshinaga M, Maruyama I, Miyata K.

As shown in FIG. 15 (note that the graphic uses individual protein scale standardization) the computer based analysis system described herein identified B-cell epitopes in the regions 30-40, 126-155, 208-210 and 230-240. Four experimentally mapped B-cell epitopes occur in the first three of these regions. Positions 35-55, 60-90, 110-125 and 185-205 correspond to predicted MHC II binding regions. Interestingly, the B-cell epitope we predict at positions 230-235 does not match an experimental B-cell epitope, but is associated with an experimentally defined MHC II binding domain.

As pointed out elsewhere in the specification, the preferred method of affinity standardization is using a whole proteome scale. This effectively ranks the individual peptide affinities in a way relevant to an infectious organism being digested by an antigen presenting cell when all peptides are presumably available for binding. The *staphylococcal* enterotoxin B protein is an example of why the distinction between whole proteome vs. individual protein standardization is important. It is a relatively small molecule and has a number of very high affinity MHC II binding regions. The patterns are identified slightly differently when 15-mer binding standardization is done on at proteome scale rather than on individual proteins. When a proteome standardization is used the regions from amino acid 210 to 230 and 240-250 are predicted to be below the proteomic 10th percentile and MHC II binding peptides are predicted in those regions. As can be seen from the graphics, the binding affinities in the region are quite high, but considering that extensive regions of this molecule have very much higher affinities, when ranked only within the molecule these two regions do not meet the 10th percentile threshold.

C. *Staphylococcal* Enterotoxin a SA00239-1 NC_002952.49484070

*Staphylococcal* enterotoxin A is the cause of serious disease and is highly immunogenic and called a "superantigen" because of its potent immunostimulatory activity. It is implicated in the pathogenesis of superantigen-mediated shock. A number of studies have mapped the regions in the molecule for either MHC II binding or antibody (B-cell epitope) binding. We examined five such studies, detailed in the abstracts below. The amino acid indices in the papers must be adjusted for signal peptide cleavage to align with the intact molecule defined in Genbank. The regions indicated in FIG. 15 by the dense blue horizontal arrows indicated the regions mapped in one or more of the papers. The sequences predicted by the present computer assisted analysis are shown in orange (B-cell binding), blue (MHC-II in top 10% percentile of binding affinity) and green (MHC-II in top 10% binding affinity plus a B cell epitope in top 25% probability). FIG. 15 demonstrates concordance in identification of MHC binding regions.

Can J Microbiol. 2000 February; 46(2):171-9. Defining a novel domain of *staphylococcal* toxic shock syndrome toxin-1 critical for major histocompatibility complex class II binding, superantigenic activity, and lethality. Kum W W, Laupland K B, Chow A W.

J Infect Dis. 1996 December; 174(6):1261-70. A mutation at glycine residue 31 of toxic shock syndrome toxin-1 defines a functional site critical for major histocompatibility complex class II binding and superantigenic activity. Kum W W, Wood J A, Chow A W.

J Infect Dis. 2001 Jun. 15; 183(12):1739-48. Epub 2001 May 16. Inhibition of *staphylococcal* enterotoxin A-induced superantigenic and lethal activities by a monoclonal antibody to toxic shock syndrome toxin-1. Kum W W, Chow A W.

Vaccine. 2000 Apr. 28; 18(21):2312-20. Recombinant expression and neutralizing activity of an MHC class II binding epitope of toxic shock syndrome toxin-1. Rubinchik E, Chow A W.

J Vet Med Sci. 2001 March; 63(3):237-41. Analysis of the epitopes on *staphylococcal* enterotoxin A responsible for emetic activity. Hu D L, Omoe K, Saleh M H, Ono K, Sugii S, Nakane A, Shinagawa K.

As seen in FIG. 15 the computer based system correctly predicts the epitopes identified by these studies.

D. *Staphylococcus aureus* Iron Regulated Determinant B (IsdB) SA00645 NC_002951.57651738

Iron sensitive determinant B (IsdB) is a protein attached to the cell wall by a sortase reaction and is being studied for use as a potential vaccine. One study has defined epitopes within the molecule using eight different monoclonal antibodies. The antibodies have varying degrees of cross reactivity with different epitopes suggesting that they define non-linear epitopes. The vertical arrows in the figure delineate specific mutations that were made in recombinant proteins to define the epitope regions. Amino acid numbering in the paper corresponds to the Genbank index even though the molecule has a signal peptide.

Figure 16A:
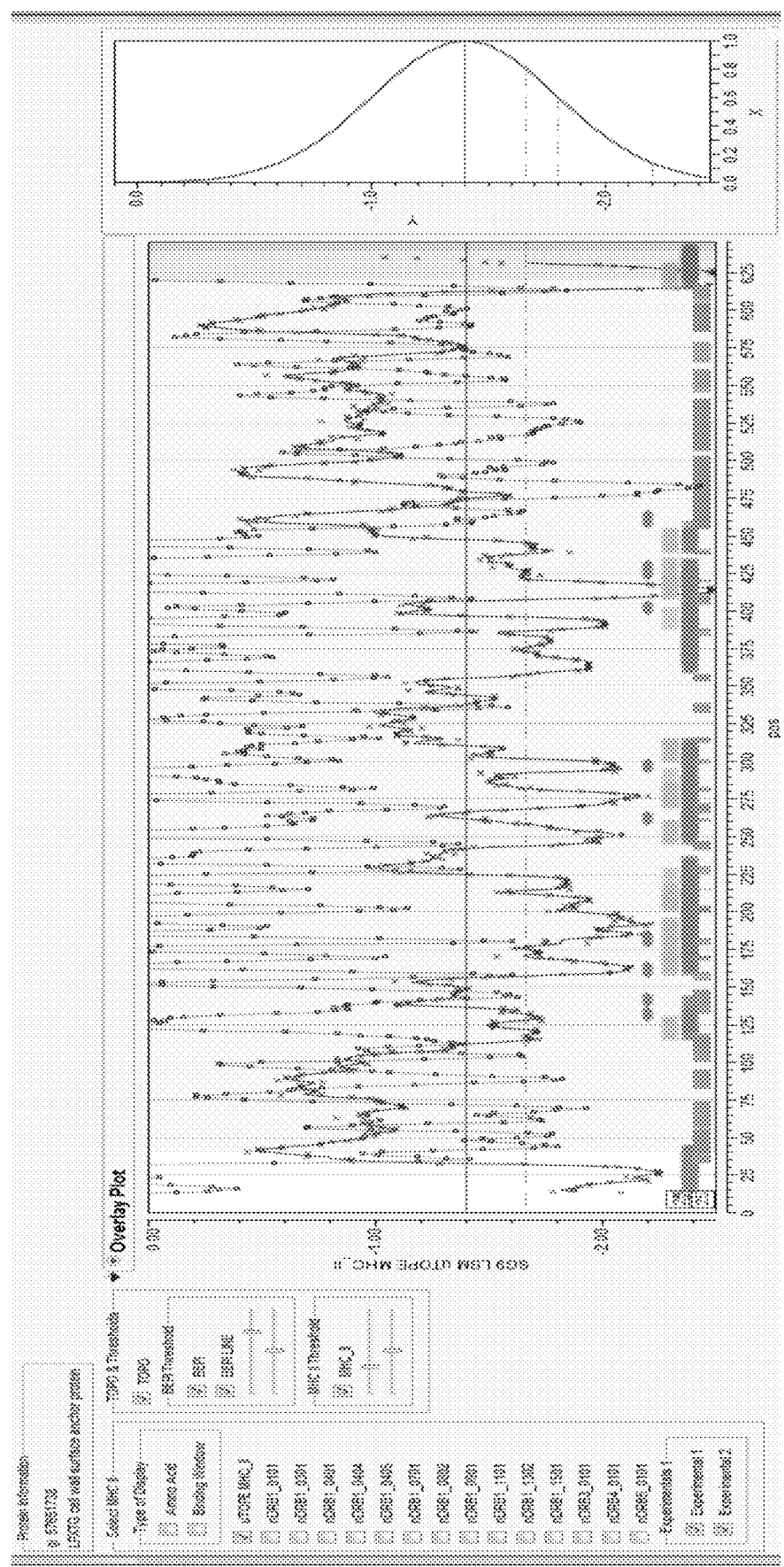
Figure 16B:
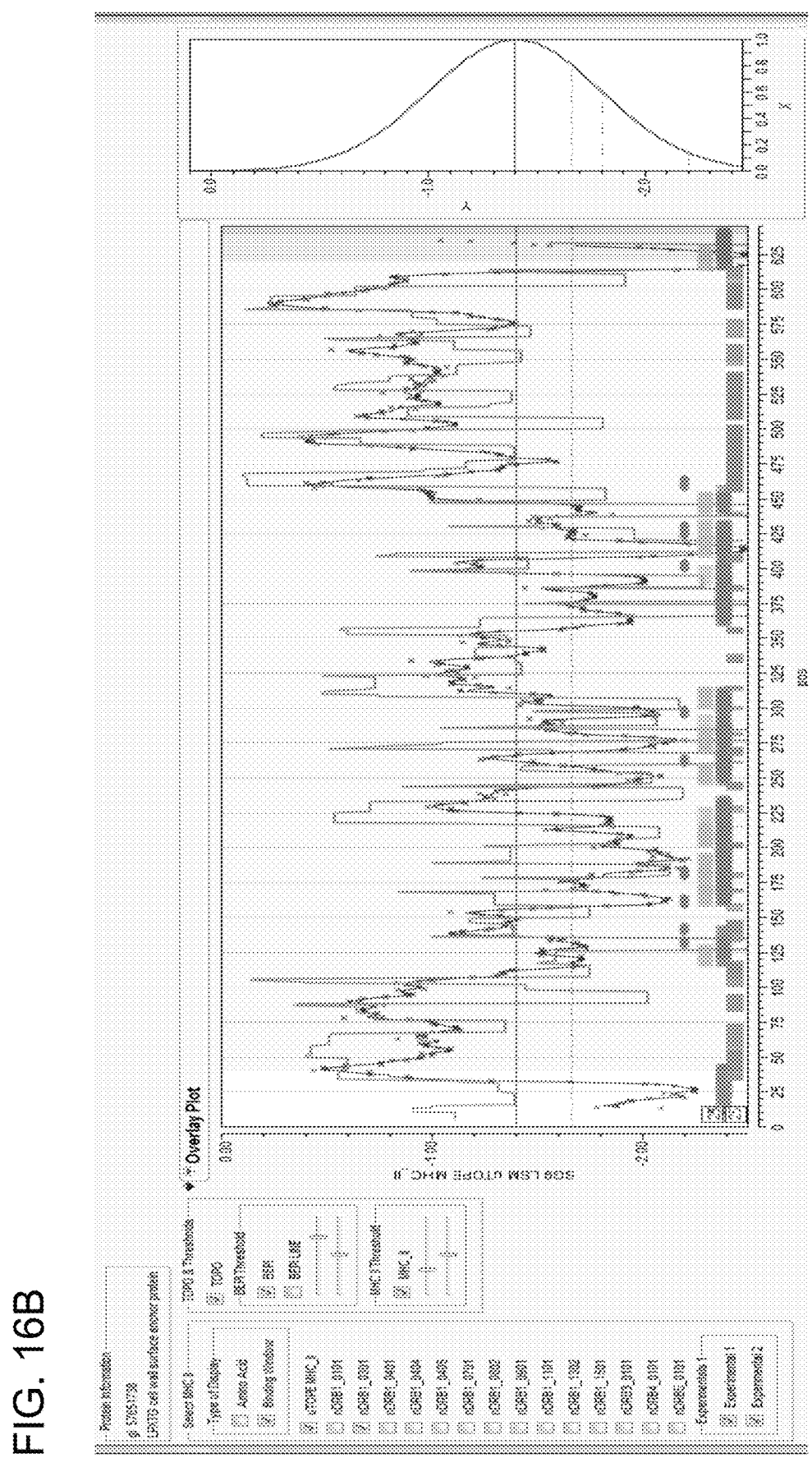
Figure 16C:
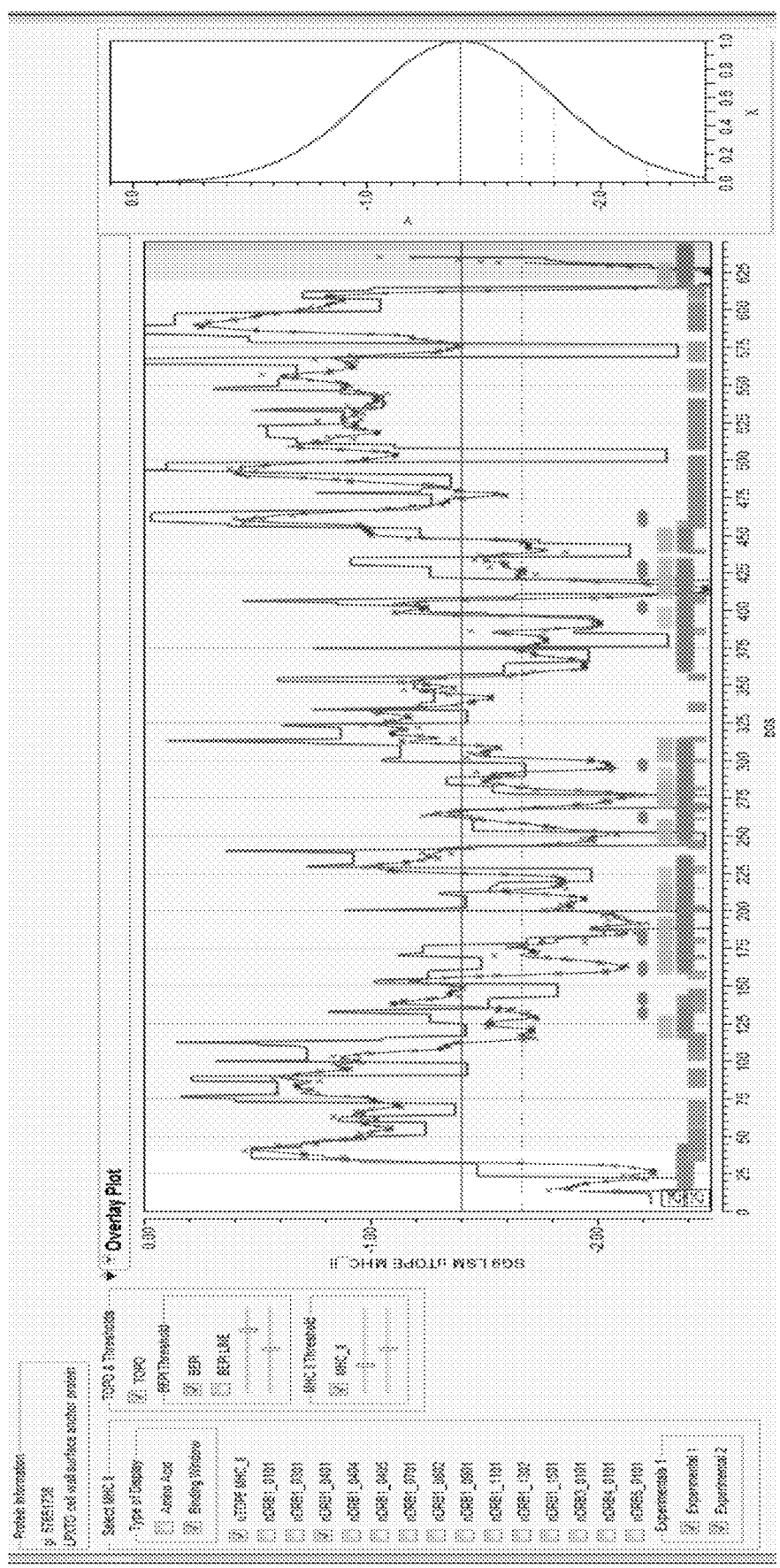

Clin. Vaccine Immunol. 2009. 16: 1095-1104. Selection and characterization of murine monoclonal antibodies to *Staphylococcus aureus* iron-regulated surface determinant B with functional activity in vitro and in vivo. Brown, M., Kowalski, R., Zorman, J., Wang, X. M., Towne, V., Zhao, Q., Secore, S., Finnefrock, A. C., Ebert, T., Pancari, G., Isett, K., Zhang, Y., Anderson, A. S., Montgomery, D., Cope, L., and McNeely, T. These workers describe preparation of a panel of 12 Mabs to the protein *Staph. aureus* iron regulated surface determinant B(IsdB) which has been used in vaccine development (Kuklin et al., 2006). The antigen epitope binding was examined in detail for eight Mabs binding sites. Analysis compared binding to progressive muteins of Isd, competitive binding among the antibodies and binding to *Staph aureus*. Based on competitive binding the 8 Mabs were found to bind to three epitopes. The location of the epitopes was mapped by mutein binding as shown in FIG. 1 in the publication. These demonstrate that some antibodies bound to multiple peptide sequences. Our FIG. 16 correlates the epitope peptide sequences identified by Brown et al with the prediction made for this protein by our computer based analysis.

E. Analysis of *Staphylococcus aureus* ABC Transporter Protein SA00533 NC_002951.5765.1892

Sera from patients that survive serious illness caused by methicillin-resistant *Staphylococcus aureus* have been found to carry antibodies that recognize a certain number of molecules that are immunodominant. One of these is a molecule in what is known as the ABC transporter. Work by Burnie et al, abstract cited below, delineated the locations in the molecule where the antibodies bound most strongly. It should be pointed out that other regions of the molecule also generated antibody responses but detailed study was limited to only certain peptides that appeared to generate the strongest responses. This molecule does not have a signal peptide and the amino acid indices in the paper match those of intact molecule in Genbank.

Figure 17:
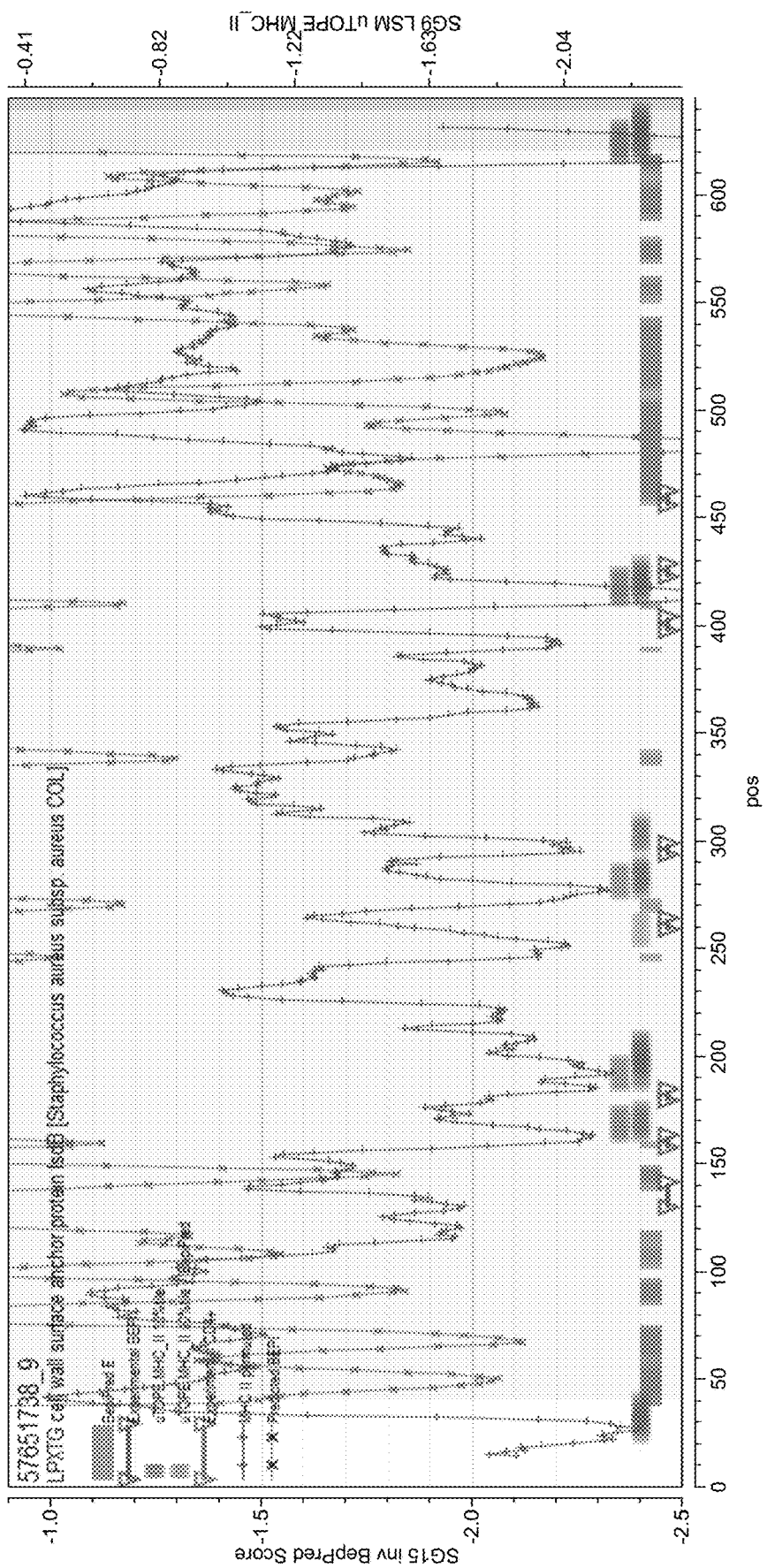

Infect Immun. 2000 June; 68(6):3200-9. Identification of an immunodominant ABC transporter in methicillin-resistant *Staphylococcus aureus* infections. Burnie J P, Matthews R C, Carter T, Beaulieu E, Donohoe M, Chapman C, Williamson P, Hodgetts S J. FIG. 5 illustrates the coincidence of predictions made by the computer based analysis system with three of the sequences identified by Burnie. As Burnie et al focused on those regions eliciting the strongest reaction (red triangles limited lines in FIG. 17) absence of correlation with further active regions identified by the computer based analysis system is not indicative of a false positive.

Example 2

Correlation with Experimental Data Training Set Made Available by the Jenner Institute The Jenner Institute has established a reference data set of B epitopes based on meta-analysis of published information. This is considered an authoritative resource for testing B epitope predictors. As downloaded from a repository site at (cbs.dtu. dk/services/BepiPred/) the dataset consisted of 124 proteins derived from a very diverse eukaryotic and prokaryotic sources as shown in Table 8.

TABLE 8

Data Set provided by the Jenner Institute as a training set of proteins. Sequences and source information are available at mhcbindingpredictions.immuneepitope.org/dataset.html.
AntiJen_ID >2505 CAC1A_HUMAN O00555 Voltage-dependent P/Q-type calcium channel alpha-1A subunit (Voltage- gated calcium channel alpha subunit Cav2.1) (Calcium channel, L type, alpha-1 polypeptide isoform 4) (Brain calcium channel I) (BI). - *Homo sapiens* (Human).
>192 RAC3_MOUSE P60764 Ras-related C3 botulinum toxin substrate 3 (p21-Rac3). - *Mus musculus* (Mouse).
>274 TPM_PANST O61379 Tropomyosin (Allergen Pan s 1) (Pan s I). - *Panulirus stimpsoni* (Spiny lobster).
>204 SRPP_HEVBR O82803 Small rubber particle protein (SRPP) (22 kDa rubber particle protein) (22 kDa RPP) (Latex allergen Hev b 3) (27 kDa natural rubber allergen). - *Hevea brasiliensis* (Para rubber tree).
>414 CPXA_PSEPU P00183 Cytochrome P450-cam (EC 1.14.15.1) (Camphor 5-monooxygenase) (P450cam). - Pseudomonas putida.
>189 RASN_HUMAN P01111 Transforming protein N-Ras. - *Homo sapiens* (Human).
>266 ETXB_STAAU P01552 Enterotoxin type B precursor (SEB). - *Staphylococcus aureus*.
>1464 CO1A1_HUMAN P02452 Collagen alpha 1(I) chain precursor. - *Homo sapiens* (Human).
>1418 CO2A1_HUMAN P02458 Collagen alpha 1(II) chain precursor [Contains: Chondrocalcin]. - *Homo sapiens* (Human).
>150 GLPA_HUMAN P02724 Glycophorin A precursor (PAS-2) (Sialoglycoprotein alpha) (MN sialoglycoprotein) (CD235a antigen). - *Homo sapiens* (Human).
>178 LACB_BOVIN P02754 Beta-lactoglobulin precursor (Beta-LG) (Allergen Bos d 5). - Bos 100ening (Bovine).
>362 OMPF_ECOLI P02931 Outer membrane protein F precursor (Porin ompF) (Outer membrane protein 1A) (Outer membrane protein IA) (Outer membrane protein B). - *Escherichia coli*.
>170 FMC1_ECOLI P02971 CFA/I fimbrial subunit B precursor (Colonization factor antigen I subunit B) (CFA/I pilin) (CFA/I antigen). - *Escherichia coli*.
>508 VL1_HPV1A P03099 Major capsid protein L1. - Human papillomavirus type 1a.
>500 VL1_HPV6B P69899 Major capsid protein L1. - Human papillomavirus type 6b.
>531 VL1_HPV16 P03101 Major capsid protein L1. - Human papillomavirus type 16.
>505 VL1_CRPVK P03102 Major capsid protein L1. - Cottontail rabbit (shope) papillomavirus (strain Kansas) (CRPV).

TABLE 8-continued

Data Set provided by the Jenner Institute as a training set of proteins. Sequences and source information are available at mhcbindingpredictions.immuneepitope.org/dataset.html.
AntiJen_ID >495 VL1_BPV1 P03103 Major capsid protein L1. - Bovine papillomavirus type 1.
>507 VL2_HPV1A P03105 Minor capsid protein L2. - Human papillomavirus type 1a.
>459 VL2_HPV6B P03106 Minor capsid protein L2. - Human papillomavirus type 6b.
>473 VL2_HPV16 P03107 Minor capsid protein L2. - Human papillomavirus type 16.
>649 VE1_HPV16 P03114 Replication protein E1. - Human papillomavirus type 16.
>365 VE2_HPV16 P03120 Regulatory protein E2. - Human papillomavirus type 16.
>158 VE6_HPV16 P03126 E6 protein. - Human papillomavirus type 16.
>504 COA3_AAV2 P03135 Probable coat protein 3. - Adeno-associated virus 2 (AAV2).
>183 CORA_HPBVY P03146 Core antigen. - Hepatitis B virus (subtype ayw).
>641 EBN1_EBV P03211 Epstein-Barr nuclear antigen-1 (EBNA-1). - Epstein-Barr virus (strain B95-8) (HHV-4) (Human herpesvirus 4).
>198 VCO7_ADE05 P68951 Major core protein precursor (Protein VII) (pVII). - Human adenovirus 5 (HadV-5).
>2332 POLG_FMDVO P03305 Genome polyprotein [Contains: Leader protease (EC 3.4.22.46) (P20A); Coat protein VP4; Coat protein VP2; Coat protein VP3; Coat protein VP1; Core protein p12; Core protein p34; Core protein p14; Genome- linked protein VPG; Proteas
>308 YPX1_BLVJ P03412 Hypothetical PXBL-I protein (Fragment). - Bovine leukemia virus (Japanese isolate BLV-1) (BLV).
>501 VL1_HPV11 P04012 Major capsid protein L1. - Human papillomavirus type 11.
>455 VL2_HPV11 P04013 Minor capsid protein L2. - Human papillomavirus type 11.
>139 UMUD_ECOLI P04153 UmuD protein (EC 3.4.21.—) [Contains: UmuD' protein]. - *Escherichia coli*, - *Escherichia coli* O157:H7, and - *Shigella flexneri*.
>176 RNMG_ASPRE P67876 Ribonuclease mitogillin precursor (EC 3.1.27.—) (Restrictocin). - Aspergillus restrictus.
>128 GLPC_HUMAN P04921 Glycophorin C (PAS-2') (Glycoprotein beta) (GLPC) (Glycoconnectin) (Sialoglycoprotein D) (Glycophorin D) (GPD). - *Homo sapiens* (Human).
>1630 MSP1_PLAFK P04932 Merozoite surface protein 1 precursor (Merozoite surface antigens) (PMMSA) (P190). - *Plasmodium falciparum* (isolate K1/Thailand).
>482 K2C8_HUMAN P05787 Keratin, type II cytoskeletal 8 (Cytokeratin 8) (K8) (CK 8). -*Homo sapiens* (Human).
>497 VL1_BPV2 P06458 Major capsid protein L1. - Bovine papillomavirus type 2.
>238 VGLG_HHV11 P06484 Glycoprotein G. -Human herpesvirus 1 (strain 17) (HHV-1) (Human herpes simplex virus - 1).
>394 OM1M_CHLTR P06597 Major outer membrane protein, serovar L2 precursor (MOMP). - Chlamydia trachomatis.
>396 APOA4_HUMAN P06727 Apolipoprotein A-IV precursor (Apo-AIV) (ApoA-IV). - *Homo sapiens* (Human).
>193 RHOA_HUMAN P61586 Transforming protein RhoA (H12). - *Homo sapiens* (Human).
>192 RHO2_YEAST P06781 RHO2 protein. - *Saccharomyces cerevisiae* (Baker's yeast).
>568 VL1_HPV18 P06794 Major capsid protein L1. - Human papillomavirus type 18.
>617 HEMA_MEASH P06830 Hemagglutinin-neuraminidase (EC 3.2.1.18). - Measles virus (strain Halle) (Subacute sclerose panencephalitis - virus).
>3391 POLG_DEN2J P07564 Genome polyprotein [Contains: Capsid protein C (Core protein); Envelope protein M (Matrix protein); Major envelope protein E; Nonstructural protein 1 (NS1); Nonstructural protein 2A (NS2A); Flavivirin protease NS2B regulatory subu
>357 VL2_BPV4 P08342 Minor capsid protein L2. - Bovine papillomavirus type 4.
>138 PA2A_CRODU P08878 Crotoxin acid chain precursor (CA) (Crotapotin). - *Crotalus durissus terrificus* (South American rattlesnake).
>623 VGLE_VZVD P09259 Glycoprotein E precursor (Glycoprotein GI). - Varicella-zoster virus (strain Dumas) (VZV).
>99 CH10_MYCTU P09621 10 kDa chaperonin (Protein Cpn10) (groES protein) (BCG-A heat shock protein) (10 kDa antigen). - *Mycobacterium tuberculosis*.
>402 OM1E_CHLPS P10332 Major outer membrane protein precursor (MOMP). - Chlamydia psittaci (Chlamydophila psittaci).
>336 FLA1_BORBU P11089 Flagellar filament 41 kDa core protein (Flagellin) (P41) (41 kDa antigen). - *Borrelia burgdorferi* (Lyme disease spirochete).
>765 TOP1_HUMAN P11387 DNA topoisomerase I (EC 5.99.1.2). - *Homo sapiens* (Human).
>932 VGLB_BHV1C P12640 Glycoprotein I precursor (Glycoprotein GVP-6) (Glycoprotein 11A) (Glycoprotein 16) (Glycoprotein G130) (Glycoprotein B). - Bovine herpesvirus 1.1 (strain Cooper) (BoHV-1) (Infectious bovine - rhinotracheitis virus).
>699 VGLG_HHV2H P13290 Glycoprotein G. - Human herpesvirus 2 (strain HG52) (HHV-2) (Human herpes simplex virus - 2).
>393 OMPA1_NEIMC P13415 Major outer membrane protein P.IA precursor (Protein IA) (PIA) (Class 1 protein). - Neisseria 101eningitides (serogroup C).
>1455 GTFC_STRMU P13470 Glucosyltransferase-SI precursor (EC 2.4.1.5) (GTF-SI) (Dextransucrase) (Sucrose 6-glucosyltransferase). - *Streptococcus mutans*.
>350 PORF_PSEAE P13794 Outer membrane porin F precursor. - Pseudomonas aeruginosa.
>217 OS25_PLAFO P13829 25 kDa ookinete surface antigen precursor (Pfs25). - *Plasmodium falciparum* (isolate NF54).
>272 RSR1_YEAST P13856 Ras-related protein RSR1. - *Saccharomyces cerevisiae* (Baker's yeast).
>910 PERT_BORPE P14283 Pertactin precursor (P.93) [Contains: Outer membrane protein P.69]. - Bordetella pertussis.
>569 URE2_HELPY P69996 Urease beta subunit (EC 3.5.1.5) (Urea amidohydrolase). - Helicobacter pylori (Campylobacter pylori).
>137 REF_HEVBR P15252 Rubber elongation factor protein (REF) (Allergen Hev b 1). - *Hevea brasiliensis* (Para rubber tree).
>205 RHOQ_HUMAN P17081 Rho-related GTP-binding protein RhoQ (Ras-related GTP-binding protein TC10). - *Homo sapiens* (Human).

TABLE 8-continued

Data Set provided by the Jenner Institute as a training set of proteins. Sequences and source information are available at mhcbindingpredictions.immuneepitope.org/dataset.html.
AntiJen_ID >204 RRAS2_MOUSE P62071 Ras-related protein R-Ras2. - *Mus musculus* (Mouse).
>400 VMSA_HPBV9 P17101 Major surface antigen precursor. - Hepatitis B virus (subtype adw/strain 991).
>504 VL1_HPV31 P17388 Major capsid protein L1. - Human papillomavirus type 31.
>393 OM1E_CHLTR P17451 Major outer membrane protein, serovar E precursor (MOMP). - Chlamydia trachomatis.
>890 ADHE_ECOLI P17547 Aldehyde-alcohol dehydrogenase [Includes: Alcohol dehydrogenase (EC 1.1.1.1) (ADH); Acetaldehyde dehydrogenase [acetylating] (EC 1.2.1.10) (ACDH); Pyruvate-formate-lyase deactivase (PFL deactivase)]. - *Escherichia coli*, and - *Esche*
>659 DNAK_CHLTR P17821 Chaperone protein dnaK (Heat shock protein 70) (Heat shock 70 kDa protein) (HSP70) (75 kDa membrane protein). - Chlamydia trachomatis.
>183 RAP2B_RAT P61227 Ras-related protein Rap-2b. - *Rattus norvegicus* (Rat).
>209 TNNI3_HUMAN P19429 Troponin I, cardiac muscle (Cardiac troponin I). - *Homo sapiens* (Human).
>393 OM1L_CHLTR P19542 Major outer membrane protein, serovar L1 precursor (MOMP). - Chlamydia trachomatis.
>338 G3P_SCHMA P20287 Glyceraldehyde-3-phosphate dehydrogenase (EC 1.2.1.12) (GAPDH) (Major larval surface antigen) (P-37). - *Schistosoma mansoni* (Blood fluke).
>360 PGS2_BOVIN P21793 Decorin precursor (Bone proteoglycan II) (PG-S2). - Bos 102ening (Bovine).
>397 OM1N_CHLTR P23114 Major outer membrane protein, serovar L3 precursor (MOMP). - Chlamydia trachomatis.
>394 OM1B_CHLTR P23421 Major outer membrane protein, serovar B precursor (MOMP). - Chlamydia trachomatis.
>396 OM1A_CHLTR P23732 Major outer membrane protein, serovar A precursor (MOMP). - Chlamydia trachomatis.
>389 VMSA_HPBVA P24025 Major surface antigen precursor. - Hepatitis B virus (strain alpha1).
>510 VL1_HPV2A P25486 Major capsid protein L1. - Human papillomavirus type 2a.
>3010 POLG_HCVBK P26663 Genome polyprotein [Contains: Capsid protein C (Core protein) (p21); Envelope glycoprotein E1 (gp32) (gp35); Envelope glycoprotein E2 (gp68) (gp70) (NS1); p7; Protease NS2 (EC 3.4.22.—) (p23) (NS2-3 proteinase); Protease/helicase
>3011 POLG_HCV1 P26664 Genome polyprotein [Contains: Capsid protein C (Core protein) (p21); Envelope glycoprotein E1 (gp32) (gp35); Envelope glycoprotein E2 (gp68) (gp70) (NS1); p7; Protease NS2 (EC 3.4.22.—) (p23) (NS2-3 proteinase); Protease/helicase
>170 CAF1_YERPE P26948 F1 capsule antigen precursor. - Yersinia pestis.
>433 NCAP_PUUMS P27313 Nucleocapsid protein (Nucleoprotein). - Puumala virus (strain Sotkamo/V-2969/81).
>668 COAT_FCVC6 P27404 Capsid protein precursor (Coat protein). - Feline calicivirus (strain CFI/68 FIV) (FCV).
>620 HEMA_MEASY P28081 Hemagglutinin-neuraminidase (EC 3.2.1.18). - Measles virus (strain Yamagata-1) (Subacute sclerose panencephalitis - virus).
>1459 CO2A1_MOUSE P28481 Collagen alpha 1(II) chain precursor [Contains: Chondrocalcin]. - *Mus musculus* (Mouse).
>398 CARP2_CANAL P28871 Candidapepsin 2 precursor (EC 3.4.23.24) (Aspartate protease 2) (ACP 2) (Secreted aspartic protease 2). - *Candida albicans* (Yeast).
>331 OMPB1_NEIMB P30690 Major outer membrane protein P.IB precursor (Protein IB) (PIB) (Porin) (Class 3 protein). - Neisseria 102eningitides (serogroup B).
>942 ENV_CAEVG P31627 Env polyprotein precursor (Coat polyprotein) [Contains: Surface protein; Transmembrane protein]. - Caprine arthritis encephalitis virus (strain G63) (CAEV).
>1060 VP2_AHSV4 P32553 Outer capsid protein VP2. - African horse sickness virus 4 (AHSV-4) (African horse sickness virus - (serotype 4)).
>395 VGLD_CHV1 P36342 Glycoprotein D precursor. - Cercopithecine herpesvirus 1 (CeHV-1) (Simian herpes B virus).
>337 TALDO_HUMAN P37837 Transaldolase (EC 2.2.1.2). - *Homo sapiens* (Human).
>609 HEMA_RINDR P41355 Hemagglutinin-neuraminidase (EC 3.2.1.18). - Rinderpest virus (strain RBOK) (RDV).
>536 SPM1_MAGGR P58371 Subtilisin-like proteinase Spm1 precursor (EC 3.4.21.—) (Serine protease of Magnaporthe 1). - *Magnaporthe grisea* (Rice blast fungus) (*Pyricularia grisea*).
>310 ALL2_ASPFU P79017 Major allergen Asp f 2 precursor (Asp f II). - Aspergillus fumigatus (Sartorya 103eningit).
>394 CARP_CANTR Q00663 Candidapepsin precursor (EC 3.4.23.24) (Aspartate protease) (ACP). - *Candida tropicalis* (Yeast).
>212 OSPC2_BORBU Q08137 Outer surface protein C precursor (PC). - *Borrelia burgdorferi* (Lyme disease spirochete).
>193 MP70_MYCTU P0A668 Immunogenic protein MPT70 precursor. - *Mycobacterium tuberculosis*.
>396 TRPB_ECO57 Q8X7B6 Tryptophan synthase beta chain (EC 4.2.1.20). - *Escherichia coli* O157:H7.
>262 MSA2_PLAFC Q99317 Merozoite surface antigen 2 precursor (MSA-2) (Allelic form 1). - *Plasmodium falciparum* (isolate Camp/Malaysia).
>95 AAO62007 *Mycobacterium_tuberculosis_6_kDa_early_secretory_antigenic_target_(ESAT-6)*
>200 AAQ55744 *Drosophila_melanogaster*_DNA_directed_RNA_polymerase_II_largest-subunit
>653 HS70_LEIDO Leishmania_donovani_Heat_Shock_protein_70-kDa
>92 K11B_LEIIN Kinetoplastid_membrane_protein-11
>735 O56652 Adeno_associated_virus_2-VP-2
>533 O92917 Adeno_associated_virus_2-VP-3
>379 P34_SOYBN Soybean_Gly_Bd_30K
>153 Q25763 *Plasmodium_falciparum*_RAP-1
>149 Q25784 *Plasmodium_falciparum*_Merozite_surface_antigen
>171 Q26003 *Plasmodium_falciparum*_Rhoptry_Protein_RAP-1
>574 Q26020 *Plasmodium_falciparum*_Thrombospondin_related_anonymous_protein_(TRAP)
>278 Q47105 *Escherichia_coli*_Nonfimbrial_adhesin_CS31A TABLE 8-continued Data Set provided by the Jenner Institute as a training set of proteins. Sequences and source information are available at mhcbindingpredictions.immuneepitope.org/dataset.html.

AntiJen_ID

>593 Q51189 Neisseria_meningitidis_P64k
>90 Q80883 Human_papillomavirus_type_16_E6_protein
>494 Q81005 Human_papillomavirus_type_16_Major_capsid_protein_L1
>198 Q8QQW1 Grapevine_virus_A_capsid_protein
>488 Q8UZC2 Dengue_virus_type_2_E_Protein
>397 Q93P53 Chlamydia_trachomatis_Major_outer_membrane_protein,_serovar_C
>274 Q9JNQ0 Group_A_M1_Streptococcus_inhibitor_of_complement(Sic)_extracellular_protein
>238 Q9L8G3 Mycoplasma_agalactiae_AvgC_(30-37)
>771 Q9NGD0 Leishmania_infantum_GRP94
>374 SBP_CRYJA Japanese_Cedar_Pollen_Major_Allergen_(Cry_j_1)
>77 Q8B5P5 Human_papillomavirus_type_16_E7_protein The epitopes it documents have been identified by many labs using many experimental methods (including mapping peptides against monoclonal antibodies and serum banks). The dataset documents a total of 246 mapped B-cell epitopes. We used the computer based analysis system described herein to analyze the proteins in the Jenner set. A separate graphical display analogous to those shown in FIGS. 13-17 was generated for each of the 124 proteins. Further analysis was then conducted to determine overlaps between experimental B-cell epitopes and our predicted B epitopes and MHC II epitopes. The output of this analysis is documented in Table 9.

TABLE 9

Cross classification of B-Cell epitope predictions and MHC II predictions with the Jenner benchmark data set at a single classification stringency.

| Classification | Metric |
|---|---|
| Proteins in Benchmark dataset | 124 |
| Total Experimental BEPI (Benchmark) | 246 |
| Total Predicted BEPI | 1425 |
| True Positive(TP) | 231 |
| False Positive (FP) | 1194 |
| True Negative (TN) | -NA- |
| False Negative (Experimental without Predicted) | 15 |
| TP/FN | 231/15 = 15.4 |
| MHC II associated with Benchmark BEPI | 162/231 = 0.70 |
| MHC II associated with Predicted BEPI | 595/1425 = 0.42 |

Of 246 B-cell epitopes, we correctly predicted 231 as judged by the intersection of one or more predicted B-cell epitopes coincident with either the entire benchmark mapped region or a subset thereof. In a number of cases we predicted more than one B-cell epitope overlapping with Jenner experimentally defined B-cell epitope sequences.

We predicted a further 1194 B-cell epitopes in the protein set. That we found more predicted epitopes than the Jenner set defines is not surprising, given the relatively selective methods used experimentally (e.g. antibody driven) and the purpose of the individual experiments from which the Jenner dataset is assembled.

We predicted a total of 162 MHCII high affinity binding regions in the data set in areas either overlapping with the benchmark mapped B-cell epitopes or immediately adjacent them (defined as a regional borders within 15 amino acid residues). Of the 1425 total predicted B epitopes we predicted, 595 (42%) have an adjacent overlapping MHC-II binding region, which is significantly lower that for the 231 B-cell epitopes which we predicted that were also in the benchmark. Here we predict that 162 (70%) have overlapping MHC-II high affinity binding regions (MHC II defined as 10% tile within protein standardization). The implication of the higher percentage of coincident MHC II+ B-cell epitopes (70% vs. 42%) in the case of the mapped benchmark B-cell epitopes suggests that predicted B-cell epitopes with associated MHC II binding regions have a 66% higher probability of being productive epitopes. One explanation may be that overlapping epitopes may be more immunodominant.

Much has been written about the relatively poor performance of B-cell predictions by various bioinformatics strategies. Our approach to application of B-cell epitope prediction correctly identifies a high percentage of mapped B-cell epitopes (94% accuracy=231/246). Bioinformaticists rely on the area under the ROC as a metric for performance of their algorithms and this is done on an amino acid by amino acid basis across the entire protein. Epitope mapping is generally done with overlapping 10-mers or 20-mers and thus does not provide an amino acid level resolution. In fact, careful examination of a number of extended stretches of amino acids in defined epitopes in the benchmark set showed multiple predicted epitopes within a 20 amino acid region. Thus the predicting algorithms appear to have a higher resolution than the experimental methods used for the mapping used to generate the benchmark set.

Example 3

Analysis of Differential Binding Affinity of Certain HLA Alleles to Proteins of HTLV-1 Virus There is evidence that the clinical outcome of infection with HTLV-1 is linked to the HLA haplotype of the individual infected. This is documented in a number of papers by Kitze and coworkers (Kitze B, Usuku K, Yamano Y, Yashiki S, Nakamura M, Fujiyoshi T, Izumo S, Osame M, Sonoda S (1998) Human CD4+T lymphocytes recognize a highly conserved epitope of human T lymphotropic virus type 1 (HTLV-1) env gp21 restricted by HLA DRB1*0101. Clin Exp Immunol 111 (2): 278-285; Yamano Y, Kitze B, Yashiki S, Usuku K, Fujiyoshi T, Kaminagayoshi T, Unoki K, Izumo S, Osame M, Sonoda S (1997) Preferential recognition of synthetic peptides from HTLV-I gp21 envelope protein by HLA-DRB1 alleles associated with HAM/TSP (HTLV-I-associated myelopathy/tropical spastic paraparesis). J Neuroimmunol 76 (1-2): 50-60; Kitze B, Usuku K (2002) HTLV-1-mediated immunopathological CNS disease. Curr Top Microbiol Immunol 265 197-211). HTLV-1 causes two distinct human diseases, adult T-cell leukemia/lymphoma (ATL) and myelopathy/tropical spastic paraparesis (HAM/

TSP). Kitze et al, (Kitze et al., 1998) using cells from donors clinically affected and unaffected by HAM/TSP, examined the relationship of HLA to binding to virus envelope gp21. The full envelope glycoprotein (Genbank Accession Q03816) is now known as gp62 in its fully glycosylated form and earlier was known as (gp46) consisting of 488 amino acids. It is cleaved into the surface protein (SU) that attaches the host cell to its receptor an interaction which triggers the refolding of the transmembrane (TM) protein (gp21). Cleavage takes place between amino acids 312-313 and the resulting C-terminal fragment with the transmembrane domain is known as gp21. By convention the numbering system used is for the uncleaved protein.

Within gp21, fine specificities of peptides sp378, sp382 and sp400 were tested in T lymphocyte lines established from DRB1_0101 donors all of which had HAM/TSP in addition to ATL. The donor that carried both DRB1_0101 and DRB1_0405 binding regions (In FIGS. 18 and 19 these two HLA types are shaded gray) had the strongest responses to peptide sp378. The sp378 peptide tested was a 21-mer so a series of 15-mers were used to show the affinities of the peptides predicted by the NN. Most of the other donors were either not typed for a second HLA Class II. One seronegative donor had a DRB1_1301 binding region in addition to DRB1_0101 and showed some reactivity, particularly to sp400. FIGS. 18 and 19 show binding affinities identified by the computer based process described in this invention. Multiple sequential 15-mers were examined to cover the 22 mer used experimentally by Kitze. The boxed in cells represent 15-mers with predicted binding affinities <=50 nM. For peptide sp378 a total of 6 of 12 binding orientations have a high affinities i.e. <=50 nM.

It is noted that the two HLA classes of interest, DRB1_0101 and DRB1_0405, include some peptide affinities of <1 nM to gp21, whereas other haplotypes include some as low as 196,000 nM. Individuals of the haplotypes of interest clearly have an extraordinary response to the gp21. These findings corroborate the experimental data of Kitze et al.

Figure 20:
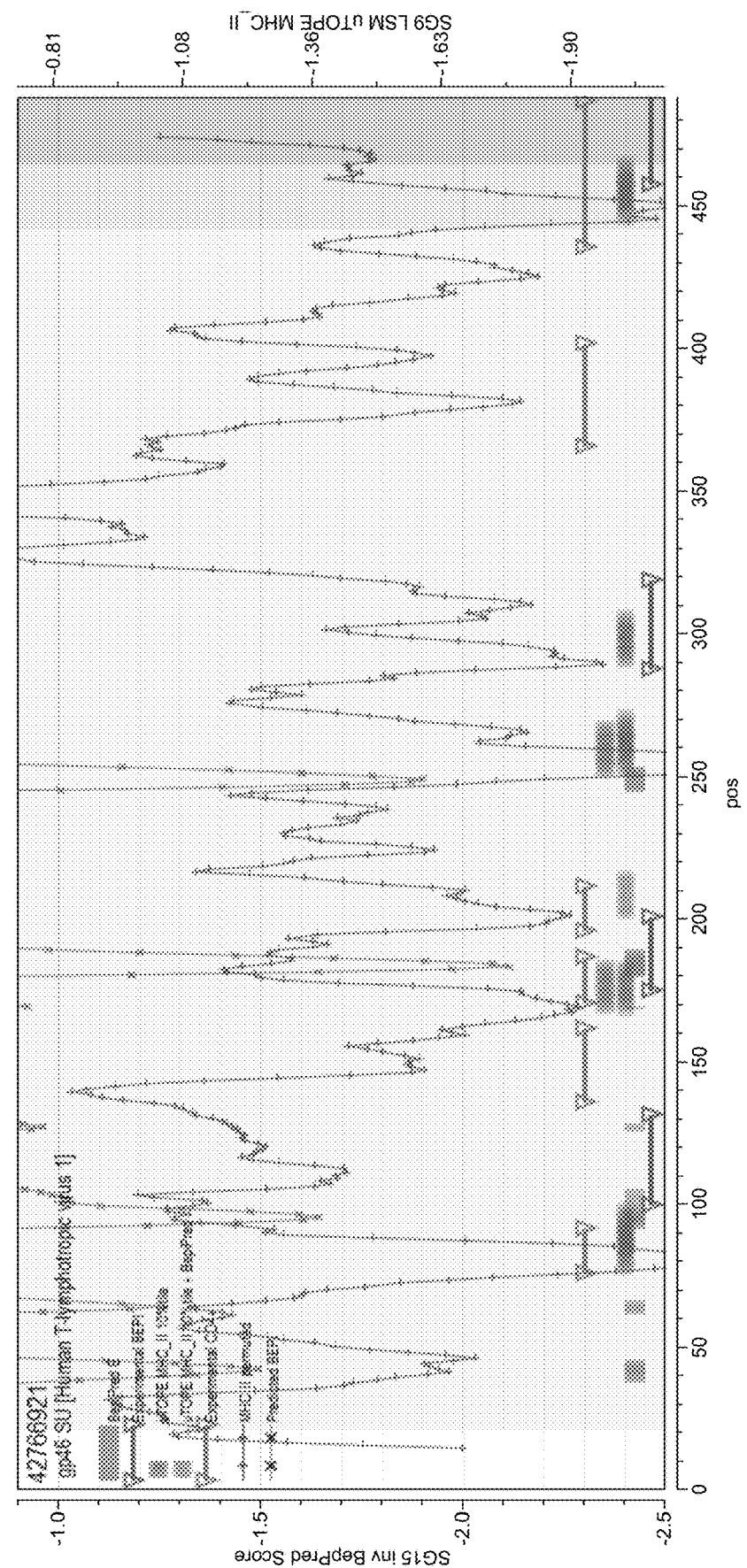

The precise positions of the experimentally determined B-cell epitopes, BepiPred predicted epitopes and MHC I and II binding affinities were then plotted for the HTLV-1 gp46. FIG. 20 shows the output. Interestingly the region associated with the extreme binding in DRB1_0101 and DRB1_0405 exhibits a MHC-II binding region in amino acid positions 365-400 not associated with B-cell binding or MHC I binding when viewed as the interface with the permuted combination of all available HLA binding regions. The occurrence of a MHC II binding region without associated B-cell and MHC I binding is an unusual occurrence and underscores the uniqueness of the peptide associated with the adverse outcomes.

Other workers have documented additional HLA specific immunodominant regions in other proteins, tax 40 and rex p27 (Kitze and Usuku, 2002).

Example 4

Analysis of *Streptococcus pyogenes* M Protein

Figure 21:
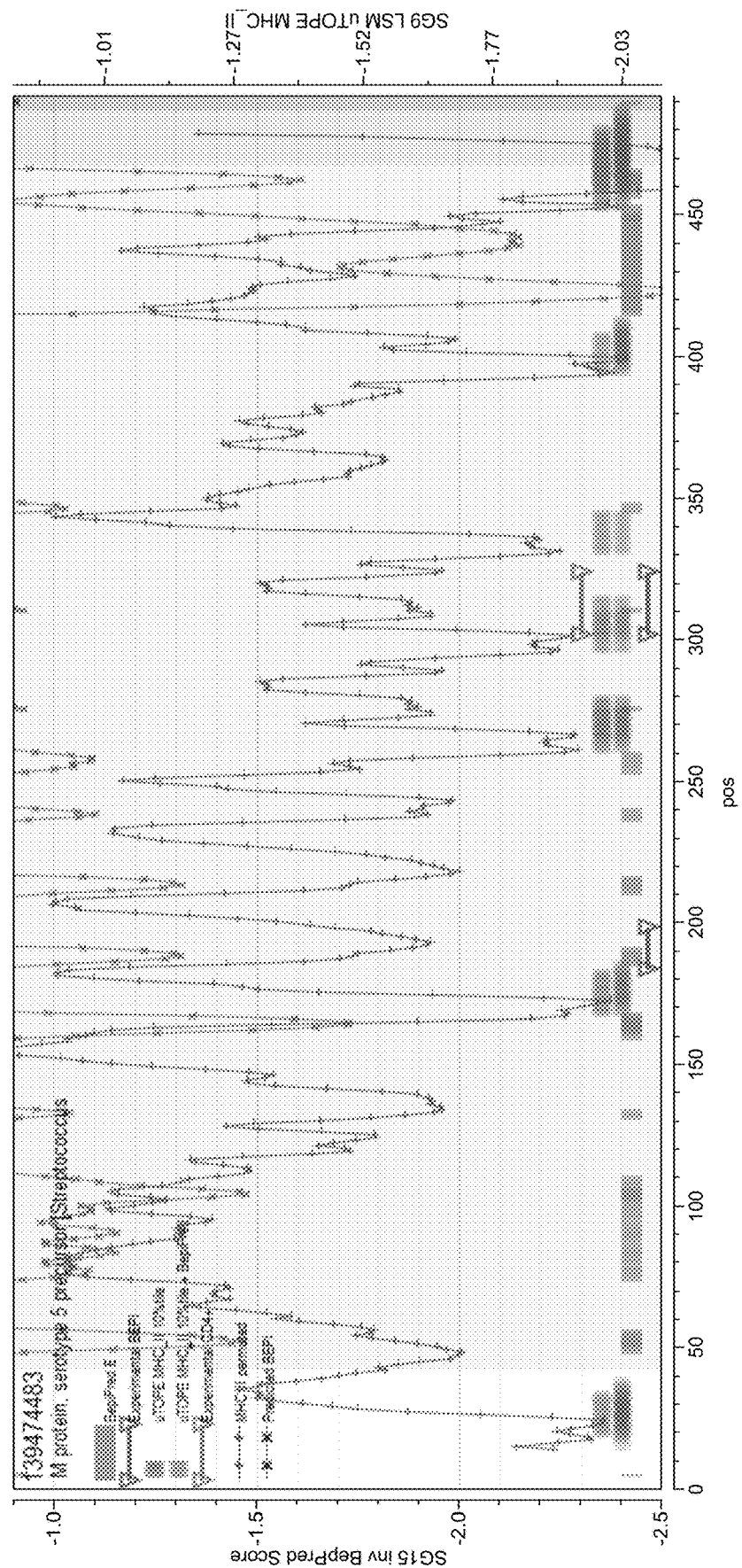

The "M" protein from *streptococcus* is a major virulence factor of this organism. It has a major role in mouse virulence, phagocytosis resistance, and resistance to opsonization by antibodies. It also is an important factor in rheumatic heart disease (RHD) associated with streptococcal infections which arises through an autoimmune response to cardiac myosin. Peptides in the region from 184-197 were mapped to their relationship to RHD by Cunningham et al (Cunningham M W, McCormack J M, Fenderson P G, Ho M K, Beachey E H, Dale J B (1989) Human and murine antibodies cross-reactive with streptococcal M protein and myosin recognize the sequence GLN-LYS-SER-LYS-GLN in M protein. J Immunol 143 (8): 2677-2683). As can be seen in FIG. 21, a predicted B-cell epitope overlaps with this mapped region and there is an adjacent area of MHC II binding peptides. The region from 302-322 were further mapped by Hayman et al (Hayman W A, Brandt E R, Relf W A, Cooper J, Saul A, Good M F (1997) Mapping the minimal murine T-cell and B-cell epitopes within a peptide vaccine candidate from the conserved region of the M protein of group A *streptococcus*. Int Immunol 9 (11): 1723-1733) for having both MHC II binding as well as B-cell epitopes and as can be seen and as can be seen the computer system described herein also provides matching predictions in these regions. The relevance of both of these regions to infectivity were recently demonstrated by deletion mutagenesis by Waldemarsson et al (Waldemarsson J, et al S (2009). PLoS One 4 (10)).

Example 5

Correlation with Certain *Mycobacterium tuberculosis* Epitopes

Mycobacteria are intracellular organisms in which CD8+ T cells are essential for host defenses. Lewinsohn et al (Lewinsohn D A. Et al PLOS Pathogens 3:1240-1249 2007) undertook to characterize the immunodominant CD8 antigens of *Mycobacterium tuberculosis* and further mapped the binding of CD8 T cells from persons with latent tuberculosis which also bound to CD4 T cell antigens. These workers identified CD8 T cell epitopes located on 4 proteins. Two of these proteins have signal peptides and fell within the set for which we mapped epitopes and so we conducted mapping for these proteins; the other two proteins were not included in our analysis.

Figure 22:
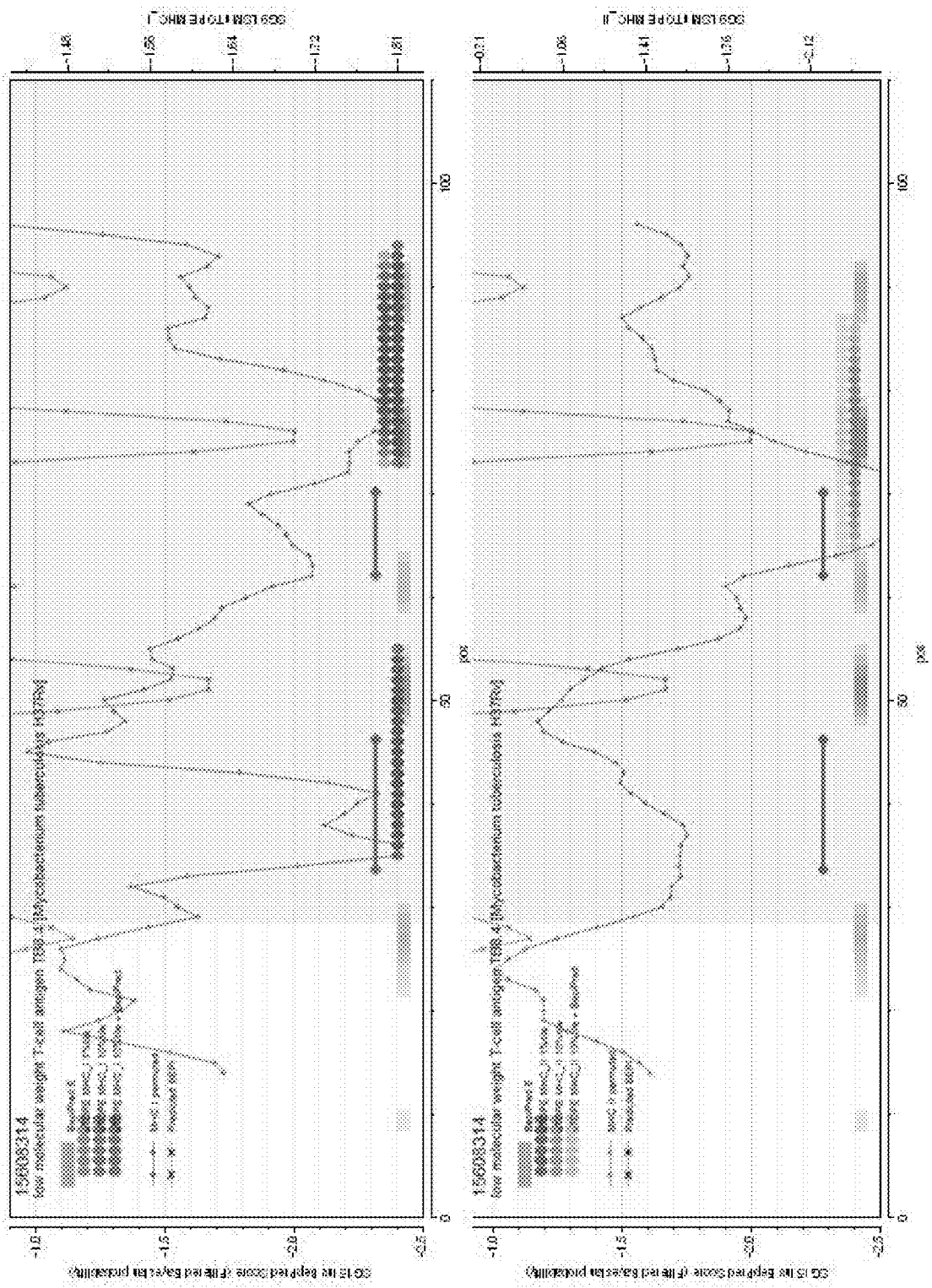

In the case of protein Mtb8.4 Lewinsohn identified T cell epitopes at amino acid positions 33-34 and 61-69. As shown in FIG. 22 the computer prediction system identified a predicted overlap of a MHC 1 high affinity region in the first sequence and an overlap of a B cell epitope and a high affinity MHC 2 binding region in the second sequence.

Figure 23:
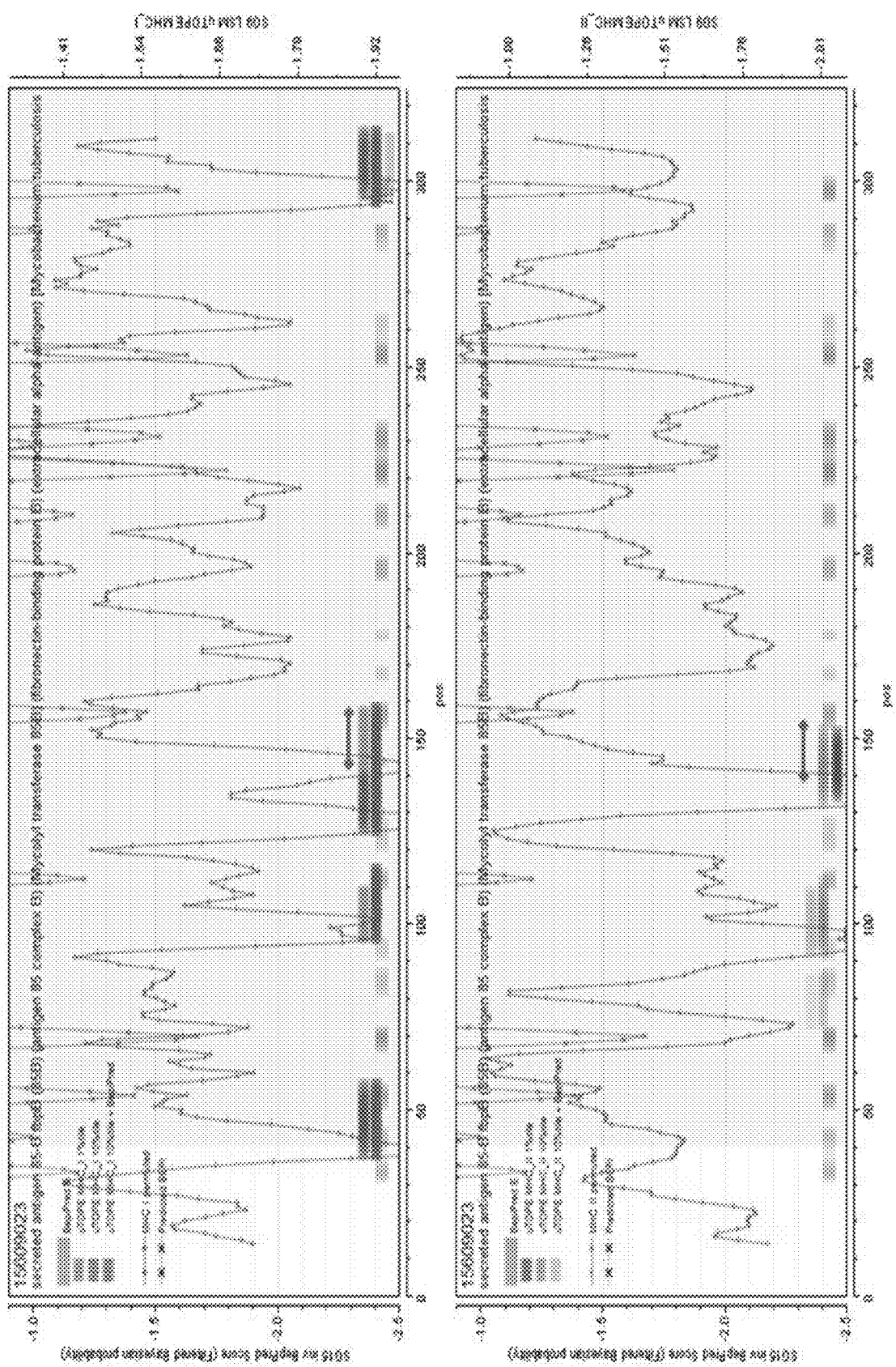

In protein 85B Lewinsohn et al mapped a T cell epitope at amino acids 144-153. As shown in FIG. 23 the computer prediction system predicted both a high affinity MHC 1 and a high affinity MHC 2 and a B cell epitope in this position.

Example 6

Use of Peptides in Antibody Preparation

From time to time the need arises to make antibodies which bind to specifically designated peptides from the surface of microorganisms. In some embodiments antibodies may be neutralizing antibodies of use as passive therapeutics, in other embodiments they may be linked to antimicrobial peptides to create an anti-infective therapeutic; and in yet further embodiments they may be used as diagnostic reagents, either alone or in combination with various tags including, but not limited to, fluorescent markers.

Many methods which are used to prepare microorganisms as immunogens for the purpose of eliciting an immune response in mice or other animals causes damage to the epitopes of interest and fails to present them in the correct position relative to membranes. Very often the epitopes are surface features external to the microbial cell membrane. The literature describes many efforts to produce antibodies by immunizing with preparations of microorganisms, including those prepared by sonicating, macerating with glass beads, boiling, and suspending membranes in a wide variety of adjuvants. These are all methods which tend to damage the integrity or attachment of surface epitopes. Immunizations with live pathogenic organisms can result in disease or death of the immunized mouse and also creates a worker safety hazard. Therefore better methods for immunization to elicit antibody responses to specific and isolated microbial peptides are needed.

Bald and Mather (US20040146990A1: Compositions and methods for generating monoclonal antibodies representative of a specific cell type), working with tumor cells and primary cell cultures, have described the advantages of presenting intact native mammalian cell surface epitopes to the immune system on injection. They have achieved this by growing said a variety of mammalian cells in serum free medium and using freshly prepared viable whole cells as the immunogen injected into mice from which lymphocytes are subsequently harvested and used to prepare hybridoma lines.

We hypothesized that individual microbial peptides could be selected and expressed as cell surface epitopes by selecting peptides which comprise transmembrane helices in regions flanking epitopes of interest and introducing them into continuous cell lines using a retrovector transfection method, such that said polypeptide epitopes are displayed on the surface of the mammalian cells and anchored by the flanking transmembrane domains.

We further hypothesized that if the underlying cell line used was syngenic with the intended host to be immunized, that an immune response could be directed primarily to the microbial peptides of interest, thereby simplifying the process of selecting a high affinity antibody directed to the microbial peptide of interest.

While mice are most commonly the species used to prepare hybridomas, the inventions described herein are not restricted to immunization of mice, but may be used to raise antibodies in any species of interest (guinea pigs, goats, chickens and others); such antibodies may then be harvested for experimental or therapeutic use without the need to further produce hybridomas. The cell line established for expression of the microbial protein may be a preexisting continuous line as is the case for Balb/c mice in which the 3T3 line is available (ATCC reference) or may be a primary line e.g. of fibroblasts established from the species, or individual, intended for immunization.

Further the lymphocytes harvested from the immunized host, or the hybridoma lines can be the source to derive antibody variable region sequences then used to make recombinant proteins.

A. Selection of Peptides for Immunization

Peptides were selected to contain both high affinity MHC binding regions and B cell epitope sequences using the bioinformatic analysis system described above. The peptides are shown in the following Table 10 and in FIGS. 40-44.

The *Staphylococcal* peptides selected are shown in Table 10. Given the intent to display the peptides on the cell surface of mammalian cells the coding sequences for the peptides were genetically linked at their 3'-end (C-terminus) to the 5'-end of the sequence encoding the full M2 molecule, an ion channel molecule found in the membrane of the influenza virus (we used strain A/Puerto Rico/8/34(H1N1). Expression of these gene fusions in mammalian cells (like CHO) leads to membrane anchored peptides displayed on the surface of the expressing mammalian cell. Presence of the peptides on the cell surface was demonstrated indirectly via immunofluorescence microscopy-based detection of the M2 portion on fixed CHO cells.

Table 10. For the proteins from the surfome of *Staphylococcus aureus* listed in this table epitopes were selected by the methods outlined in the specification and as shown in FIGS. 40-44.

TABLE 10

| Genbank ID | Position | Protein | Amino Acid Sequence | Topology |
|---|---|---|---|---|
| 57650405 | 382-445 | Penicillin-binding protein 2 | KDVVNRNQATDPHPTGSSLKPFL AYGPAIENMKWATNHAIQDESS YQVDGSTFRNYDTKSHGTV | Extracellular |
| 57651010 | 712-779 | Fibronectin-binding protein A | GLGTENGHGNYDVIEEIEENSHV DIKSELGYEGGQNSGNQSFEEDT EEDKPKYEQGGNIVDIDFDSVP | Membrane and Extracellular |
| 57651165 | 15-65 | Capsular polysaccharide galactosyltransferase | VVLSPILLITALLIKMESPGPAIFK QKRPTINNELFNIYKFRSMKIDTP NV | Extracellular |
| 57651437 | 648-695 | Collagen-binding protein B domain | TTETDENGKYRFDNLDSGKYKV IFEKPAGLTQTGTNTTEDDKDAD GGE | Extracellular |
| 57651379 | 1746-1800 | Cell wall associated fibronectin-binding protein | DGETTPITKTATYKVVRTVPKHV FETARGVLYPGVSDMYDAKQY VKPVNNSWSTN | Extracellular |

B. Preparation of Retrovector Constructs for Transfection and Production of Stably Transfected Cell Lines The protein sequence (as determined above by bioinformatics analysis) was reverse translated using Lasergene software using 'strongly expressed non-degenerate *E. coli* back translation code'. Start, c-terminal tag and stop sequences were added as well as 5' and 3' restriction sites for cloning. The fully assembled nucleotide sequence was submitted to Blue Heron (Blue Heron Biotechnology, Bothwell Wash.) for synthesis. Synthesized sequences were transferred to a retroviral construct in a single directional cloning step. The retroviral constructs are used to produce retrovector which is subsequently used to transduce Balb/c 3T3 cells or other selected cell lines syngenic with the immunization host. Alternatively they could be transfected into primary cells from the intended immunization host. Expression of the polypeptides on the cell surface is demonstrated by immunofluorescence assay using a fluorescently labeled anti-c-myc antibody.

C. Harvesting of Cells and Use as an Immunogen for Production of Hybridomas

Cells prepared as described above are grown in the absence of serum and transported to the mouse facility in cell culture medium at a known concentration of cells per milliliter. Immediately prior to use the cells are centrifuged and sufficient cells to provide an inoculum of $10^6$ cells per mouse resuspended in DMEM medium and mixed 1:1 with Sigma Adjuvant System® (SAS) suspended in isotonic saline (Sigma S6322 comprising Monophosphoryl Lipid A (detoxified endotoxin) from *Salmonella minnesota* and synthetic Trehalose Dicorynomycolate in 2% oil (squalene)-Tween 80-water) and immediately loaded into a syringe for inoculation.

To control for proper immunization procedures two positive controls are included in at least one immunization round: control immunogens include the following: OVA (grade V chicken ovalbumin, Sigma A5503), 50 µg complexed with 2 mg alum (Al(OH)3) in PBS in SAS; Heat-inactivated whole *Staph aureus* cells suspended in SAS; Heat-inactivated whole *Staph aureus* cells partially trypsin digested, suspended in SAS; Outer membrane preparation (achieved by sonication and centrifugation procedure described by Ward et al (Ward K H, Anwar H, Brown R W, Wale J, Gowar J. Antibody response to outer-membrane antigens of *Pseudomonas aeruginosa* in human burn wound infection. J Med Microbiol 1988; 27(3): 179-90.) of *Pseudomonas aeruginosa*, suspended in SAS.

Mice are restrained and inoculated on the inner surface of one of their hocks as described by Kamala (Kamala T. J Immunol Methods 2007; 328(1-2): 204-14). A volume not to exceed 0.05 ml is injected using a 27 g needle.

An initial inoculation on Day 0 is followed by 3-4 boost in 2-3 week intervals, depending on seroconversion of the animals. Seven days after the last booster, mice are sacrificed by CO2 asphyxiation. Blood samples are collected via maxillary vein puncture 7 days after each booster to monitor antigen-specific antibody titer. Antibody titers are determined via whole cell ELISA using both recombinant 3T3 cells and *Staph aureus* cells. Good antibody titers are at least 10 fold above pre-immunization levels.

Following euthanasia harvesting of iliac and inguinal lymph nodes is performed as described by Van den Broeck et al [Van den Broeck W, Derore A, Simoens P. J Immunol Methods 2006; 312(1-2): 12-9.] and transported to the lab for homogenization and fusion with myeloma lines. Production of hybridoma lines is done following the methods initially described by Kohler and Milstein Nature 1975 Aug. 7; 256(5517):495-7.

Specifically mice were immunized with an initial injection of antigen formulated in adjuvants (e.g. Sigma Adjuvant System, S6322) followed by two to three booster immunizations over the period of 4-6 weeks. Bleeding was done to confirm seroconversion and determine antigen-specific immunoglobulin titer. Titers in the range of 1:25,000-125,000 are considered a good response. Mice with a good antigen-specific antibody titer are sacrificed using isoflurane anesthesia and exsanguination followed by necropsy to retrieve various lymphatic tissue samples including draining lymph nodes for the injection site and spleen. The tissue samples are homogenized using frosted microscope slides and passage through mesh filters, followed by two wash steps in DMEM/F12. The spleen samples are subjected to hypotonic shock and filtration over glass wool to remove erythrocytes. Lymphocytes from each collection site are then counted and the ratio for the fusion with the Sp2/0-Ag14 (ATCC #CRL-1581) murine myeloma cell line determined. The fusion between lymphocytes and myeloma cells is mediated via addition of 35% PEG (Polyethylene glycol, Sigma P7777) followed by culturing in selective medium that eliminates non-fused cells. One day after the fusion the cells are plated into 100 mm Petri dishes using selective medium formulated with semi-solid methylcellulose (Clonacell, Stemcell Technologies, Vancouver, Canada). After 14 days, visible clones are picked from the methylcellulose plates by single-clone aspiration using a standard laboratory pipet (Gilson, Middleton, Wis.) and transferred into a 96-well plate containing selective medium. Following several days of growth in the 96-well plate supernatants of each well are removed and analyzed for binding specificity and affinity to the immunized antigen. Positive wells are identified and the clonal hybridoma further expanded for antibody production and cryopreservation.

D. Production of Recombinant Antibodies

The process of producing recombinant antibodies from hybridomas has been described in prior patent filings, See, e.g., U.S. patent application Ser. Nos. 10/844,837; 11/545, 601; 12/536,291; and Ser. No. 11/254,500; each of which is incorporated herein by reference. In brief, supernatants from hybridoma cell lines are tested for the presence of murine antibody. Upon confirmation of presence of antibody in the supernatant, total RNA is extracted from freshly grown hybridoma cells. RNA is reverse transcribed using oligo dT primer to generate cDNA from mRNA transcripts. This cDNA is then used for the extraction of immunoglobulin genes using a series of PCR reactions. The use of degenerate PCR primers allows the extraction of variable region DNA for both heavy and light chain from reverse transcribed RNA (cDNA). Degenerate primer kits for this purpose are commercially available (Novagen, EMD Biosciences, San Diego, Calif.). The PCR products obtained are cloned and sequenced.

Immunoglobulin variable regions obtained are typically fused to existing constant regions using overlap extension PCR. The light chain variable and constant regions are assembled using similar procedures to those for the heavy chain. These components are then ready to be incorporated into the mammalian expression vector.

Typically we produce retrovector from both HC and LC constructs to do separate transductions of host cells as desired. Briefly, retrovector particles are made using a packaging cell line that produces the capsid, and reverse transcriptase and integrase enzymes. Retrovector constructs for the transgene and VSVg construct for the pseudotype are co-transfected into the packaging cell line which produces pseudotyped retrovector particles which are harvested using supra-speed centrifugation and concentrated vector is used to transduce Chinese hamster ovary (CHO) cells. The transduced cell pools are then subjected to limiting dilution cloning to locate a single cell into each well of a microtiter plate. Following two weeks of incubation the resulting clones are analyzed by product quantification in their supernatant. Typically about 200 clones are analyzed and the top-producing clones are selected and expanded. A clonal cell line usually contains multiple copies of the transgene and is stable over at least 60 passages. As soon as a clone is identified as a "top clone" it is immediately cryopreserved and backed up at two locations. Established clonal cell lines are then grown at volumes that meet the demands of the downstream tests.

Example 7

Correlation with Other Bioinformatics Methods

The JMP® platform has a variety of mechanisms and statistical output for "training" of the NN, in order to control the underlying non-linear regression convergence, to assess the statistical reliability of the output, and to monitor and control overfitting through the use of an overfitting penalty coefficient. We systematically experimented with these control elements to evaluate the quality of the predictions through several cross validation strategies. We found that the presence of peptide subsets with different numbers of peptides, some having radically different mean affinities in the predictors (detected as latent factors in the PLS), are also somewhat problematic for random selection of training subsets during cross validation. The results of two different strategies are reported here. The two different models are referred to as Method 1 and Method 2.

In Method 1 multiple "tours" (different random seeds) of a random holdback strategy were used. Examination of the residuals in the various hyperplanes was used to examine the residuals of these fits. In as much as the three principal components we used for the model account for approximately 90% of variance in the underlying physical properties, we set the overfitting penalties to target an $r^2$ of 0.9. For benchmarking, the prediction models the IEDB datasets downloaded from CBS were contemporaneously submitted to the web servers for NetMHCII (version 2.0) and NetMHCIIPan (version 1.0) at CBS. Buus et al., Sensitive quantitative predictions of peptide-MHC binding by a 'Query by Committee' artificial neural network approach. *Tissue Antigens* 2003, 62:378-384. Nielsen et al., Reliable prediction of T-cell epitopes using neural networks with novel sequence representations. Protein Sci 2003, 12:1007-1017; Lundegaard et al., Accurate approximation method for prediction of class I MHC affinities for peptides of length 8, 10 and 11 using prediction tools trained on 9mers. *Bioinformatics* 2008, 24:1397-1398. Nielsen et al., Improved prediction of MHC class I and class II epitopes using a novel Gibbs sampling approach. *Bioinformatics* 2004, 20:1388-1397.

The performance of Method 1 is compared to the PLS model and the output of the servers at CBS in Table 11 As described above for the PLS, both an $r^2$ comparing the fit and a categorical transformation were used to make the comparisons.

The predictions produced by Method 1 and its ability to generalize in the training sets compared favorably to NetMHCII (Table 2) evaluated either as a continuous fit or as a categorical classifier. The statistical metrics associated with the model suggested that some overfitting was likely occurring with this model and therefore a second method (Method 2) was developed.

In Method 2 the prediction models were produced through the use multiple random subsets of the training set each producing a unique set of prediction equations. For example, nine random selections of ⅔ of the training set produces nine sets of prediction equations where each of the peptides will have been used six times in combinations with different peptide cohorts. The predictions of these equations were averaged to produce a mean estimate as well as a standard error of the mean. The coefficient of variation gives an estimate of the variation in the estimates. Results with two differently sized randomly selected subsets of the IEDB training sets are shown in Table 12.

Figure 24:
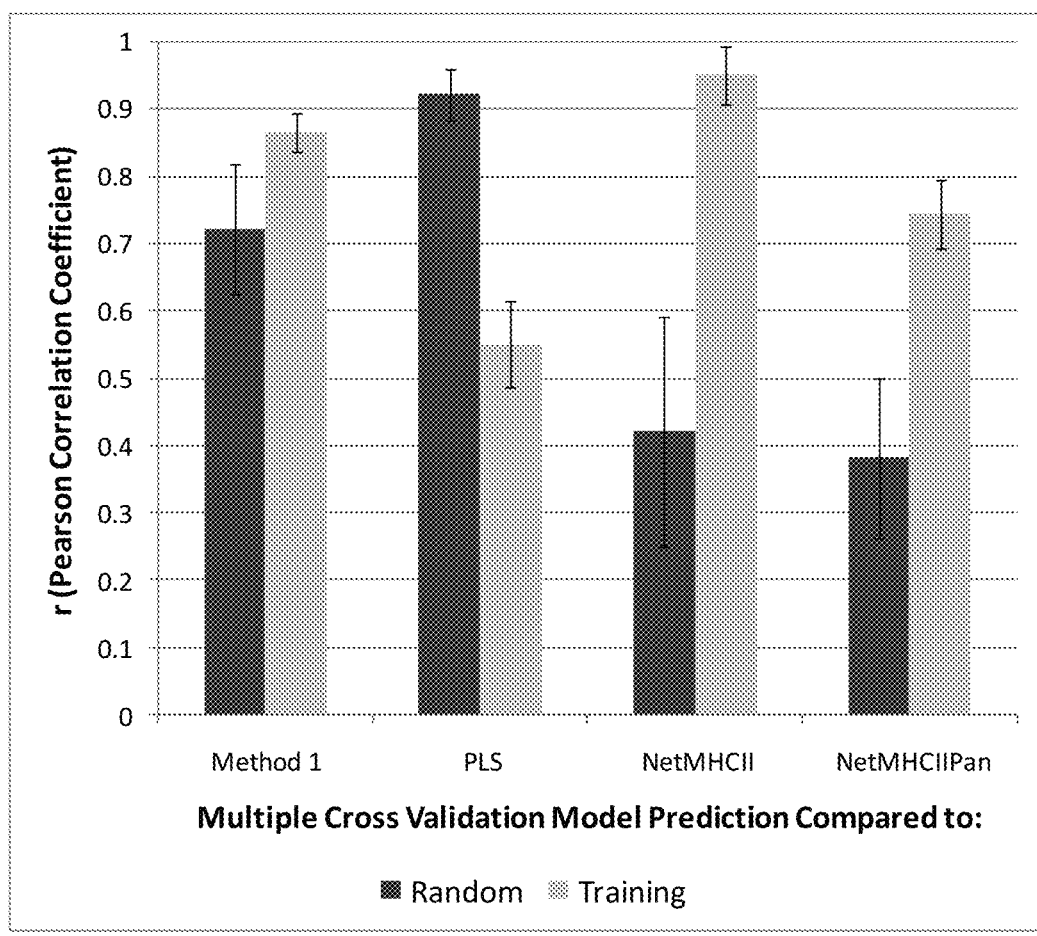

Having five prediction methods based on different underlying predictors, substitution matrices for NetMHCII and NetMHCIIPan and physical properties of amino acids for PLS, Method 1 and Method 2 described above provided an opportunity to examine the comparative performance of the different prediction methods with both the IEDB training sets as well as with other peptides. This was done by creating a test set of 1000 15-mer peptides selected at random from the proteome of *Staphylococcus aureus* COL (Genbank N.C._002951). This random test set was submitted to each of prediction tools and the results tabulated for comparison. FIG. 24 shows the results of comparisons of the different methods with Method 2 as the base method, using the Pearson correlation coefficient of the predictions as the metric for comparison for the training sets. Method 1, NetMHCII and NetMHCIIPan all produce highly correlated predictions, the highest correlations being between Method 2 and NetMHCII. The results of evaluation using categorical predictors gave comparable results (not shown).

As with the training set, the correlated response of between Method 2 and Method 1 is also seen for the random peptide set. Table 12 also shows the comparison of Method 2 with both the training set and the random set. Interestingly, with the random set the correlation with PLS is substantially better than for the training set, however the correlation between Method 2 and both NetMHCII and NetMHCIIPan is diminished. Also, the correlation coefficients of the later two prediction methods show a higher degree of variability.

TABLE 11

Comparison of Partial Least Squares and Neural Net.
The performance of partial least squares (PLS) compared to the neural network regression base on amino acid principal components (NN PCAA) described with two neural network predictors based on substitution matrices. SB and WB columns are the area under the receiver operator curve (AROC) obtained by converting the continuous for the regression fit output to a categorical output SB = strong binder (<50 nM) WB = weak binder (>50 nM and <500 nM) and non-binder (>500 nM). The $r^2$ is indicated is the metric for how well the particular predictor predicts the values in the training set.

| | PLS AROC | | | Method 1 AROC | | | NetMHCII AROC | | | NetMHCIIPan AROC | | |
|---|---|---|---|---|---|---|---|---|---|---|---|---|
| | SB | WB | $r^2$ | SB | WB | $r^2$ | SB | WB | $r^2$ | SB | WB | $r^2$ |
| DRB1*0101 | 0.713 | 0.579 | 0.541 | 0.838 | 0.645 | 0.796 | 0.848 | 0.691 | 0.811 | 0.835 | 0.647 | 0.753 |
| DRB1*0301 | 0.675 | 0.610 | 0.476 | 0.987 | 0.954 | 0.996 | 0.958 | 0.882 | 0.966 | 0.841 | 0.602 | 0.736 |
| DRB1*0401 | 0.690 | 0.537 | 0.491 | 0.986 | 0.956 | 0.995 | 0.951 | 0.845 | 0.945 | 0.778 | 0.631 | 0.636 |
| DRB1*0404 | 0.695 | 0.559 | 0.595 | 0.986 | 0.961 | 0.995 | 0.940 | 0.845 | 0.954 | 0.854 | 0.630 | 0.769 |

TABLE 11-continued

Comparison of Partial Least Squares and Neural Net.
The performance of partial least squares (PLS) compared to the neural network regression
base on amino acid principal components (NN PCAA) described with two neural network
predictors based on substitution matrices. SB and WB columns are the area under the
receiver operator curve (AROC) obtained by converting the continuous for the regression
fit output to a categorical output SB = strong binder (<50 nM) WB = weak binder
(>50 nM and <500 nM) and non-binder (>500 nM). The $r^2$ is indicated is the metric
for how well the particular predictor predicts the values in the training set.

| | PLS AROC | | | Method 1 AROC | | | NetMHCII AROC | | | NetMHCIIPan AROC | | |
|---|---|---|---|---|---|---|---|---|---|---|---|---|
| | SB | WB | $r^2$ | SB | WB | $r^2$ | SB | WB | $r^2$ | SB | WB | $r^2$ |
| DRB1*0405 | 0.702 | 0.577 | 0.527 | 0.985 | 0.966 | 0.996 | 0.927 | 0.846 | 0.947 | 0.809 | 0.588 | 0.682 |
| DRB1*0701 | 0.729 | 0.612 | 0.559 | 0.987 | 0.958 | 0.997 | 0.965 | 0.893 | 0.963 | 0.879 | 0.716 | 0.801 |
| DRB1*0802 | 0.776 | 0.602 | 0.587 | 0.990 | 0.980 | 0.997 | 0.979 | 0.880 | 0.973 | 0.841 | 0.550 | 0.770 |
| DRB1*0901 | 0.659 | 0.532 | 0.403 | 0.988 | 0.961 | 0.997 | 0.969 | 0.899 | 0.956 | 0.813 | 0.576 | 0.673 |
| DRB1*1101 | 0.681 | 0.565 | 0.550 | 0.981 | 0.957 | 0.996 | 0.968 | 0.893 | 0.969 | 0.855 | 0.594 | 0.787 |
| DRB1*1302 | 0.600 | 0.521 | 0.441 | 0.978 | 0.830 | 0.997 | 0.981 | 0.837 | 0.965 | 0.806 | 0.579 | 0.759 |
| DRB1*1501 | 0.656 | 0.552 | 0.494 | 0.987 | 0.960 | 0.995 | 0.940 | 0.795 | 0.945 | 0.768 | 0.544 | 0.667 |
| DRB3*0101 | 0.595 | 0.510 | 0.451 | 0.983 | 0.932 | 0.996 | 0.956 | 0.872 | 0.935 | 0.879 | 0.613 | 0.737 |
| DRB4*0101 | 0.724 | 0.667 | 0.604 | 0.987 | 0.966 | 0.997 | 0.686 | 0.942 | 0.976 | 0.892 | 0.621 | 0.795 |
| DRB5*0101 | 0.727 | 0.607 | 0.553 | 0.985 | 0.958 | 0.997 | 0.960 | 0.884 | 0.965 | 0.872 | 0.649 | 0.789 |
| Average | 0.687 | 0.574 | 0.519 | 0.975 | 0.927 | 0.982 | 0.931 | 0.857 | 0.948 | 0.837 | 0.610 | 0.740 |

TABLE 12

Coefficient of variation of the mean estimate of the
LN(ic50) for different alleles of human MHC-II
using two different schemes for cross validation.
The training dataset used was the IEDB dataset (Wang et al., A
systematic assessment of MHC class II peptide binding predictions
and evaluation of a consensus approach. *PLoS Comput Biol* 2008,
4: e1000048.). The random dataset consisted of 1000 15-mers
drawn from the surfome and secretome of the proteome of
*Staphylococcus aureus* COL Genbank NC_002951.

| Allele | Training 9 × 67% (1) | Random 1000 9 × 67% (2) | Training 9 × 50% (3) |
|---|---|---|---|
| DRB1_0101 | 10.4% | 14.4% | 17.8% |
| DRB1_0301 | 6.2% | 6.2% | 7.4% |
| DRB1_0401 | 9.5% | 9.5% | 6.6% |
| DRB1_0404 | 7.3% | 22.0% | 9.4% |
| DRB1_0405 | 7.9% | 7.3% | 9.3% |
| DRB1_0701 | 4.8% | 10.0% | 12.4% |
| DRB1_0802 | 7.6% | 7.0% | 8.5% |
| DRB1_0901 | 12.6% | 9.4% | 12.9% |
| DRB1_1101 | 8.3% | 7.6% | 10.2% |
| DRB1_1302 | 6.7% | 6.6% | 8.5% |
| DRB1_1501 | 10.5% | 8.3% | 10.4% |
| DRB3_0101 | 4.4% | 4.5% | 5.4% |
| DRB4_0101 | 8.6% | 6.9% | 9.8% |
| DRB5_0101 | 12.5% | 8.9% | 13.8% |
| Average | 8.4% | 9.2% | 10.2% |

(1) A random 2/3 of the data set was selected 9 times to produce 9 sets of prediction equations. Each peptide in the set was used 6 times in combination with other peptides in the training set.
(2) Equations from (1) were used to predict the LN(ic50) of the random peptides.
(3) As in (1) but half of the training set was used to develop the equations.

Example 8

Correlation with Certain Epitopes in Proteins Associated with Cutaneous Autoimmune Disease The following proteins were analyzed using the computer assisted methodology described herein based on the principal components of the component amino acids. Peptides were identified which comprise regions of high affinity binding to MHC-I or MHC-II molecules, or both and which also have a high probability of comprising a B cell epitope. This permitted us to (a) demonstrate that the computer assisted approach accurately identified epitopes previously identified experimentally by others and (b) to identify new epitope containing peptides, IN several instances the extended peptides used as experimental probes preclude precise definition of the epitopes and underscore the need for improved methods of epitope characterization. The proteins analyzed were: desmoglein 1, 3,4; collagen; annexin; envoplakin; bullous pemphigoid antigen BP180, BP230; laminin; ubiquitin; Castelman's disease immunoglobulin; integrin; desmoplakin; plakin.

Correlation with experimentally defined peptides:

a. Desmoglein 3

Bhol et al., Proc Natl Acad Sci USA 1995, 92:5239-5243, defined two polypeptides containing B cell epitopes in patients with pemphigus vulgaris. Antibodies to "Bos 6" from amino acids 200-229 were identified only in patients with active disease whereas antibodies to "Bos 1" located at amino acids 50-79 were detected in recovered patients and in healthy relatives thereof.

Figure 25:
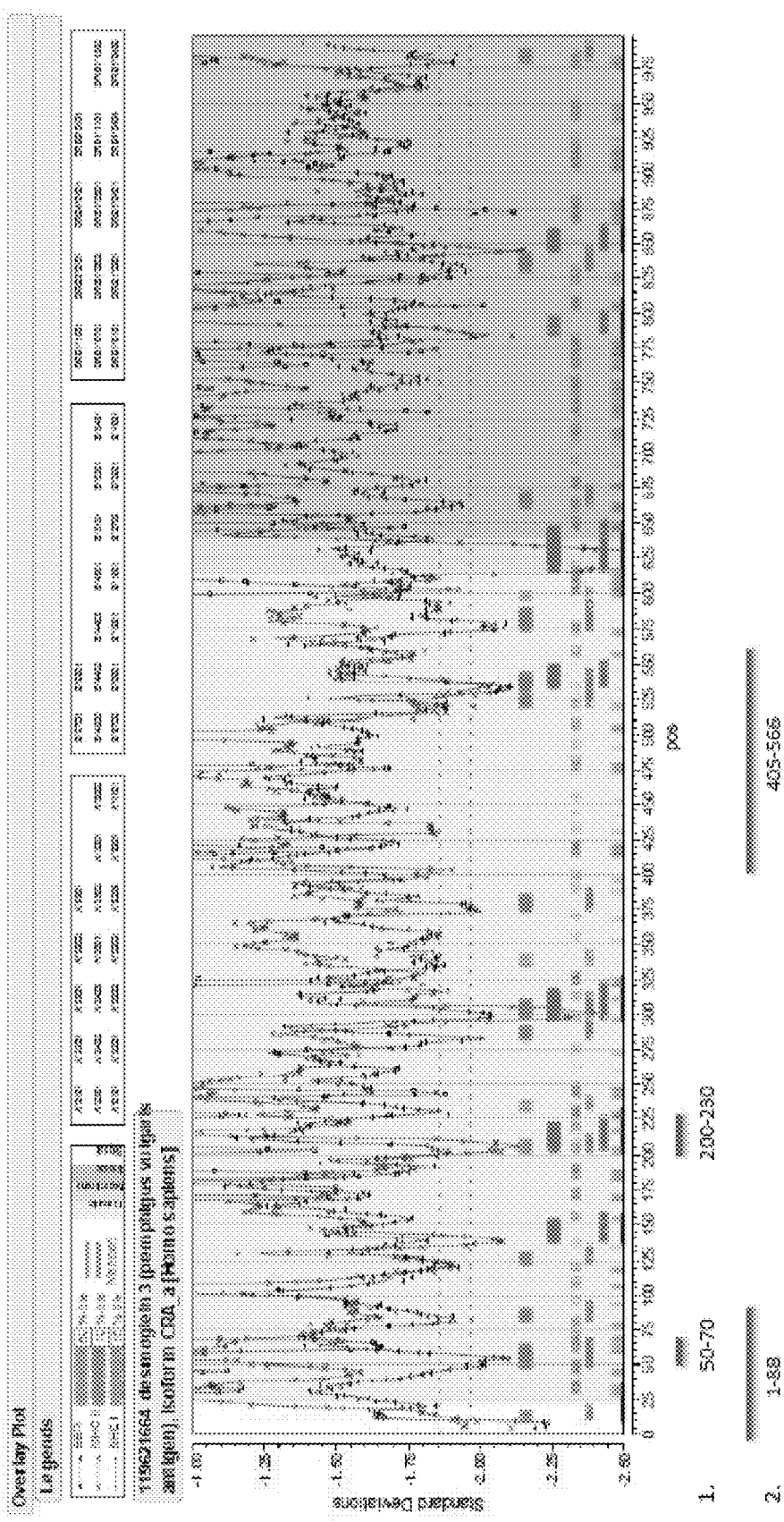

FIG. 25 shows that the computer prediction identifies an overlap of B cell epitopes, MHC-I and MHC-II high affinity binding from amino acids 200-230 and an overlap of a B cell epitope and a MHC-I from amino acids 50-70. Salato et al., Clin Immunol 2005, 116:54-64, identify the C terminal epitope in pemphigus vulgaris, which they describe as occurring between amino acids 1-88 as this is the size of the molecular probe used. They further identify another epitope lying between amino acids 405 and 566; again greater precision was precluded by the size of the probe these authors used. The computer prediction system described herein identifies multiple B cell epitopes within this range, but particularly a B cell epitope overlapping MHC-I and MHC II high affinity binding regions in the region amino acids 525-550.

b. BP 180

Collagen XV11, known as BP 180 is a hemidesmosomal transmembrane molecule in skin associated with several autoimmune diseases.

Figure 26A:
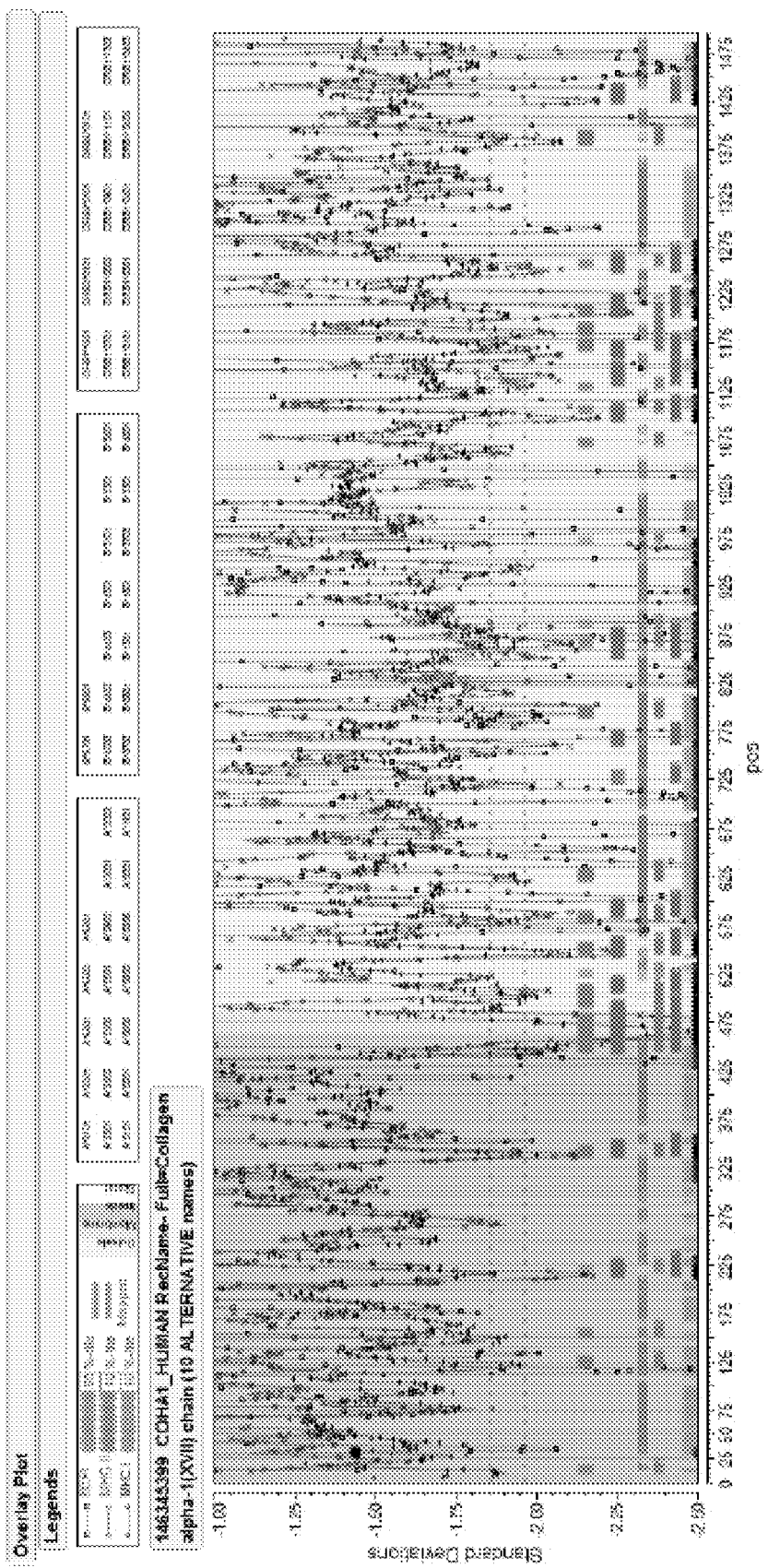
Figure 26B:
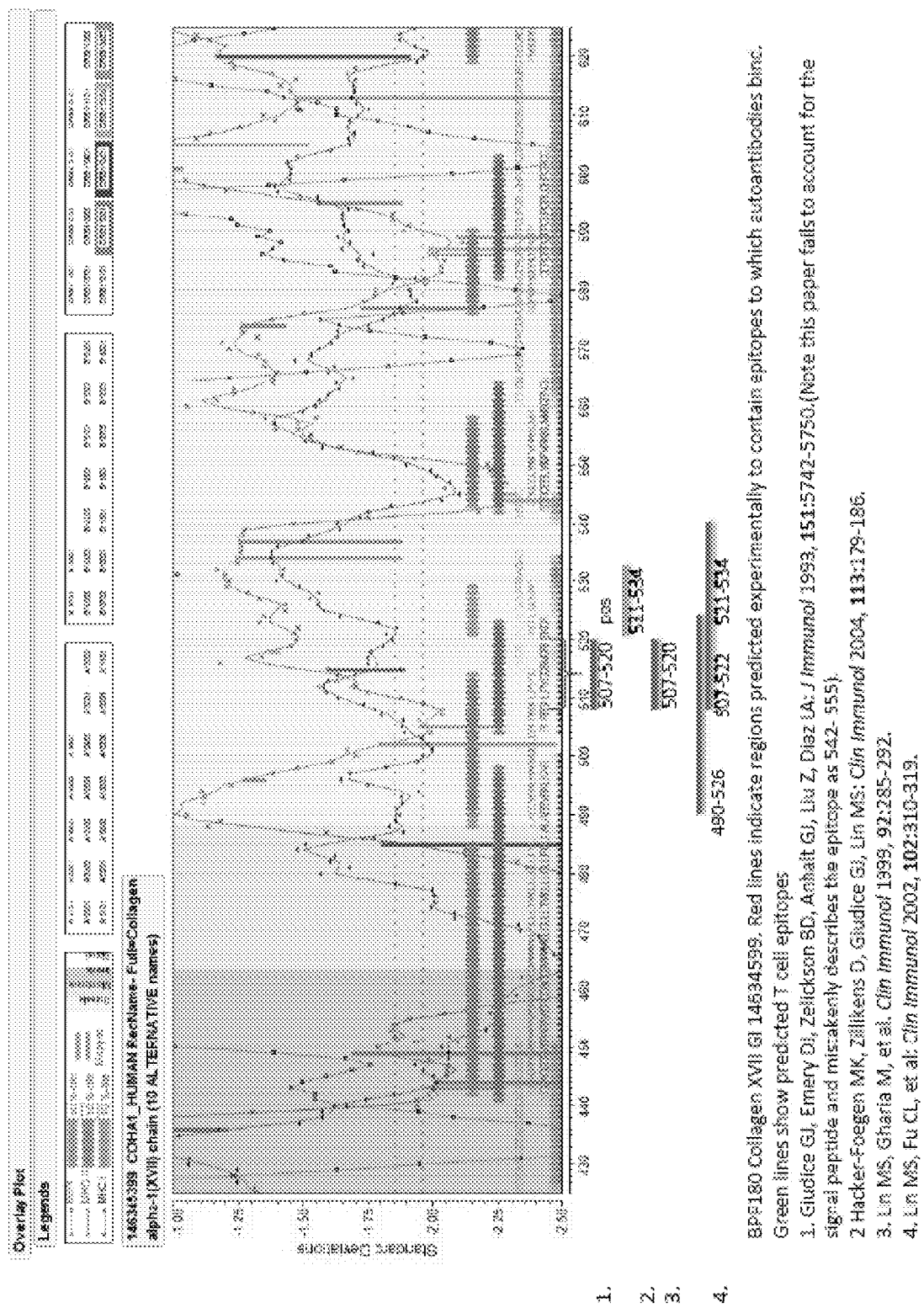

BP 180 is considered the principal protein associated with autoimmune responses for bullous pemphigoid, Giudice et al. J Invest Dermatol 1992, 99:243-250, identified autoreactive antibodies binding to a B cell epitope in the region known as NC16A at amino acids 507-520 (it should be noted their original paper uses a numbering system which starts after cleavage of the signal peptide, thereby transposing the numbers to 542-555). Further work by Hacker-Foegen et al. Clin Immunol 2004, 113:179-186 identified amino acids 521 to 534 as capable of stimulating a T cell response in patients with bullous pemphigoid and pemphigoid gestationis. FIGS. 26A and 26B show BP180 and demonstrate that the computer prediction system predicts a high affinity MHC-II regions from 505-522, a high affinity MHC-I binding region from 488-514 and from 521-529, regions which overlap with a predicted B cell epitope from 517-534 forming a coincident epitope group from 507-534.

In herpes gestationis Lin et al. Clin Immunol 1999, 92:285-292 identified a region in BP180 which elicited autoantibodies in several patients, located at amino acids 507-520; this same amino acid region elicited a T cell response in the herpes gestationis patients; this reaction was further shown to be specific to MHC II DRB restriction. Other studies (Shornick et al., J Clin Invest 1981, 68:553-555) have reported that herpes gestationis predominates in individuals of HLA DRB1*0301 and DRB1*0401/040x. FIG. 26B shows the binding affinities predicted for several individual HLAs showing standard deviations below the population permuted average. Giudice et al. J Immunol 1993, 151:5742-5750 identified the common epitope of RSILPYGDSMDRIE (aa 507-520) for bullous pemphigoid and herpes gestationis, which is noted in FIG. 26B as the predicted MHC-II binding region.

In Linear IgA bullous dermatosis (LABD), a disease in which IgA antibodies are directed against various proteins in the skin basement membrane including collagen VII, BP230 and BP180, antibodies target the NC16A region of BP 180 but are also found outside this domain in BP180 (Lin et al., Clin Immunol 2002, 102:310-319).

Lin et al. Clin Immunol 2002, 102:310-319 showed that LABD patients had T cell reactivity specifically to both the NC16 A region and to areas outside this region. LABD patient T cells were stimulated by peptides comprising aa 490-506, 507-522 and 521-534; following absorption by these peptides residual reactivity was shown indicating reactivity outside NC16A Again the MHC-I and MHC-II regions predicted to be high affinity binding regions coincide with these experimental findings.

c. Collagen VII

In epidermolysis bullous acquisitiva Muller et al. Clin Immunol 2010, 135:99-107 identified B and T cell binding regions in the non collagenous domain 1 (NC1) of collagen VII. They describe the binding of B and T cells to peptides lying between aa 611 to 1253. Our computer aided prediction shows seven discrete MHC-II high affinity binding regions within this 600 aa stretch (FIG. 27).

We have mapped these and several other proteins associated with cutaneous autoimmune disease and find that in addition to the sequences which coincide with those demonstrated experimentally as autoantigens, there are several additional coincident epitope groupings identified in each protein which have not been experimentally defined and described in the literature.

Example 9

Comparison of Predictions of MHC Binding Predictions with Experimental Results for Influenza a Proteins Obtained by ELISPOT, Tetramer Binding and Cr Release A set of 150,000 influenza A proteins was assembled from Genbank. The computer assisted method described herein was applied to identify high affinity MHC binding regions in viruses of serotype with hemagglutinin H1, H2, H3 and H5.

To generate a comparative test set of experimentally determined epitopes complete records of all influenza A epitopes listed under T cell response were downloaded from the Immune Epitope Data base (iedb.org).

These records were sorted to identify those from human or from Transgenic mice carrying HLAs. Records were excluded which did not have identification of specific HLAs or where the influenza virus name was not listed (a few were retained which had HA subtype identified but incomplete names). The list was then limited to those comprising HA1, HA3, or HA5 subtypes.

The dataset was restricted to publications or submissions dated 2000 or later. This was to provide a manageable number and to reduce nomenclature confusion.

These steps provided a list of 1228 records described in 35 publications and 5 groups of direct submissions. This included some duplicate reports of the same epitope. Epitopes associated with seven publications were eliminated because the papers were designed to develop a new assay using control epitopes, or where previously described epitopes were used in some secondary manner, for example to examine cross reactivity with non influenza epitopes.

Realizing that the designation of "positive" or "negative" made by IEDB denotes the response to a specific assay (as opposed to an absolute negative or positive) we then manually curated the list by reference to the specific publications. Some records listed as "positive" were removed because they identified a peptide status as an immunogen but not as an influenza. A group of 5 was identified as weak positive. Many more "negatives" were eliminated as this category was found to include many peptides for which the authors reported no result, some reported as weak positive, and some which were not confirmed as non-epitopes by a function of the experimental design. Four additional positive records and seven additional negative records were identified from the publications. The resultant curated dataset of experimentally defined epitopes was used for further comparisons.

Protein sequences for each of the influenza viruses identified in the database were retrieved from the Influenza FASTA file downloaded from NCBI in December 2010. A total of 124 sequences were assembled.

These sequences were split into 15-mers with a 1 amino acid offset. At least one protein of each influenza was represented in the dataset. LN(ic50) values were computed for each of the peptides in all of the proteins using the best set of equations se with the highest correlation coefficient) from the ensembles. For each of the proteins the mean value and standard deviation of the of the predicted LN(ic50) were computed and the values over all proteins were assembled to assess variability between HLAs and between proteins. Each of the HLAs have different means and variances The standardized data was used for statistical analysis of the re-curated IEDB data.

FIG. 28 shows the relationship between the subset of experimentally defined epitopes from IEDB and the standardized predicted affinity using the methods described herein. The differences shown are highly statistically significant (the diamonds are the confidence interval about the mean).

Comparison was complicated by the curation system at IEDB, where records are of a positive or negative response to a specific assay. Two peptides in FIG. 28 that were characterized as positive were called "negative" by IEDB when performing in an experiment in which they were included under adverse conditions to define the conditions under which they normally performed as positives. Hence they were false negatives which should have been removed on curation.

Example 10

Influenza: Comparative Analysis of Strains of Influenza Virus Isolated Over Time The frequent mutations in the hemagluttinin gene bring about rapid change in the surface hemagglutinin protein (HA) to which neutralizing antibodies bind. The high degree of variability of the hemagglutinin protein is well known and the constant mutation resulting in antigenic drift, allowing escape from neutralizing antibodies is an important feature of the continued transmission and survival of seasonal influenza viruses in populations (Wiley et al., Structural identification of the antibody-binding sites of Hong Kong influenza haemagglutinin and their involvement in antigenic variation. Nature 1981, 289:373-378; Ferguson et al., Ecological and immunological determinants of influenza evolution. Nature 2003, 422:428-433; Ferguson and Anderson; Predicting evolutionary change in the influenza A virus. Nat Med 2002, 8:562-563). Antigenic drift has been studied in particular detail for influenza A H3N2 which emerged first in epidemic form in 1968 and multiple specific amino acid changes associated with antigenic drift have been identified. Smith et al., Mapping the antigenic and genetic evolution of influenza virus. Science 2004, 305:371-376, have mapped the effect of progressive genetic mutations in the exposed surface hemagglutinin protein (HA1) which are associated with antigenic change, as detected by polyclonal ferret antisera, and have shown clusters of H3N2 isolates mapped to time and geography. Smith et al show sequential clusters of viruses according to the cross neutralizing ability of polyclonal sera binging the HA 1 protein.

We applied the computer assisted methods described herein to ask how patterns of antigenic drift in influenza H3N2 as monitored by antibody neutralization compared to the patterns of predicted T-cell epitopes reflected in predicted MHC binding in the HA' of influenza H3N2 over time. We examined how amino acid changes between virus isolates representative of each antigenic cluster affected MHC 2 binding.

An array of the amino acids of HA' protein from 447 H3N2 viruses was established which comprised 260 virus isolates also studied by Smith and 187 other isolates. Those clustered by Smith based on antibody reactivity were labeled with the cluster name he applied (HK68, EN72, VI75, BK79, SI87, BE89, BE92, WU95, SY97, FU02). Others were given the prefix of the year of isolation and NON. From this array consecutive 9-mer and 15-mer peptides analyzed using principal component analysis to determine the predicted binding affinity to each of 35 MHC-I and 14 MHC-II molecules (over 7 million individual peptide-MHC interactions). A predicted binding affinity score for each peptide was linked to the index amino acid of each to represent the 9mer or 15 mer downstream of it.

The array of peptide MHC binding affinities for each virus isolate was clustered based on the patterns of binding affinity of successive 9-mer and 15-mer peptides to one of 35 MHC-I or one of 14 MHC-II molecules. Dendrograms were drawn of the clustering patterns for each allele. The 447 viruses were grouped into 23 clusters. For the most part clustering based on MHC binding closely mirrors that shown by Smith et al based on polyclonal ferret antisera hemagglutination inhibition studies. As an example, FIG. 29 shows a contingency plot for the clustering of binding patterns to A*0201 and DRB1*0401. Almost all isolates from each Smith cluster group are locate within a group of 1-4 contiguous clusters based on MHC binding. Very few exceptions are noted. In the case of A*0201 the BE92, which comprises 57 isolates spans 7 clusters. Three WU95 isolates (A/Madrid/G252/93(H3N2)) 49339273 A/Netherlands/399/93(H3N2))_49339305 and A/Netherlands/372/93 (H3N2))_49339297) cluster with BE92; notably these are isolates which Smith found to be interdigitated with BE92. Only five other individual isolates were found to cluster separately from the other members of the antibody defined clusters. Comparative contingency plots for all the alleles mapped for MHC-I and MHC-II respectively showed that each allele forms a slightly different contingency plot indicative of different clustering patterns. Within each of MHC-I A, MHC-I B and DRB1 the patterns form three related groups. In each case the HA of each Smith cluster tend to locate together, but in a different relative order. NON isolates are arrayed below the Smith cluster isolates and form an approximately parallel pattern by date order in each case.

To examine the impact of specific amino acid changes associated with antigenic drift, ten representative virus isolates were chosen, one from each Smith cluster as shown in Table 13 and the HA' protein for each examined.

TABLE 13

| Cluster | Representative virus isolate | GI Accession number for HA |
| --- | --- | --- |
| HK68 | A/Bilthoven/16190/68(H3N2) | 49339049 |
| EN72 | A/England/42/1972(H3N2) | 6470275 |
| VI75 | A/Bilthoven/1761/76(H3N2) | 49338983 |
| BK79 | A/Netherlands/209/80(H3N2) | 49339065 |
| SI87 | A/Victoria/7/87(H3N2) | 2275517 |
| BE89 | A/Madrid/G12/91(H3N2) | 49339129 |
| BE92 | A/Finland/247/1992(H3N2) | 49339247 |
| WU95 | A/Wuhan/359/1995(H3N2) | 49339351 |
| SY97 | A/Netherlands/427/98(H3N2) | 49339385 |
| FU02 | A/Netherlands/22/03(H3N2) | 49339039 |

Changes in amino acids at any one amino acid locus in the transition between cluster representatives were identified which resulted in increase, decrease or retention of MHC binding affinity. FIG. 30 shows that binding affinity changes were found arising from 1 to 7 amino acid changes within any given 15-mer peptide. An example of the data set showing the changes is provided in FIGS. 31A and B and 32.

FIGS. 33A and B show the aggregate change in MHC-II binding peptides at each cluster transition, as represented by the subset of ten viruses for all MHC alleles. FIG. 33B shows the aggregate changes for DRB1*0401 as one example of the pattern derived for each allele. On an individual allele basis very few high affinity MHC binding sites are retained intact through all cluster transitions over the 34 year span.

We next constructed a plot to show the locations of peptides within HA1 affected by MHC binding changes between virus isolates. FIG. 34 shows the cumulative addition of high binding peptides across the nine cluster transitions for each MHC-II allele, FIG. 35 shows high binding affinity lost by each allele over the same transitions; FIG. 36 maps the high MHC binding affinity sites retained. Most addition and loss of high affinity MHC binding is seen in those peptides with index positions of the 15-mer between aa 150-180 and between 245-290. This places the highest probability of MHC binding change adjacent to or overlapping B cell epitope. In many cases aa identified by Smith as essential to cluster transitional changes are members of these 15-mer peptide. Once again we note the differences between individual MHC alleles. It should be noted that FIGS. 34 and 36 only represent the highest affinity binding peptide losses and gains. Losses and gains of binding sites with a lower level of affinity follow broadly similar patterns.

Example 11

Identification of Epitope Mimics

An epitope mimic is a peptide sequence in an exogenous agent, including but not limited to a peptide in pathogen such as a virus, a biotherapeutic or a food protein, that has similar physical properties and binding properties to certain HLA molecules as does an endogenous protein of the host. The presence of a mimic can create an autoimmunity where because the host has developed an immunological response to the pathogen it inadvertently creates an immunity against itself as well. This is a rare event, so it is a technical challenge is to attempt to locate these rare peptides.

Matrix Algebra Detection of Molecular Mimicry of MHC-Binding Peptides

The basic elements of the approach are to use principal components to describe the physical properties of amino acids in a peptide, wherein each amino acid described by 3 principal components. A peptide n-mer will thus have an n×3 vector that fully describes about 90% of its physical properties.

Matrix multiplication of two vectors can be used to determine the Euclidian distance between the vectors. Thus, matrix multiplication of the vectors corresponding to the two peptides physical properties can be used to calculate the "distance" (i.e. the similarity) between the physical properties of the two vectors as well as detail the distance between individual amino acids within the peptides.

In the equation below "a" is the vector of principal components for one peptide and "b" is the principal component for the other peptide. n is the number of 3× the number of amino acids in the peptide. The first three principal components are used in the computation.

The "Trace" which is defined as the sum of the diagonal of the right hand matrix is a single number that comprises an aggregate distance for the entire peptide for all amino acids.

$$AB^T = \begin{bmatrix} a_1 \\ a_2 \\ \vdots \\ a_n \end{bmatrix} [b_1\ b_2\ \cdots\ b_n] = \begin{bmatrix} a_1b_1 & a_1b_2 & \cdots & a_1b_n \\ a_2b_1 & a_2b_2 & \cdots & a_2b_n \\ \vdots & \vdots & \ddots & \vdots \\ a_nb_1 & a_nb_2 & \cdots & a_nb_n \end{bmatrix}.$$

The VIP variable importance projection of the peptide-MHC binding interaction developed by partial least squares analysis of the binding interactions defines which of the different amino acid positions play the largest role in determining the binding.

Thus, the VIP vector can be further be used as a weighting function for the distance vector to describe the "distance". This is essentially a goodness-of-fit metric.

The weighting will place appropriate emphasis (or de-emphasis) on peptides whose physical properties at specific amino acid locations.

The Trace of the matrix will thus be adjusted appropriately for the characteristic importance of different residues in the binding to the HLA.

As an example consider two protein sequences:

SEQ ID NO: 3407293

MYGIEYTTVLTFLISIILLNYILKSLTRIMDFITYRFLFIIVILSPFLRA...... N

SEQ ID NO: 3407294

MASLIYRQLLTNSYSVDLHDEIEQIGSEKTQNVTINPSPFAQTRYAP.......... M

In Step 1 each peptide 15-mer is represented as a vector of 45 (15×3 principal components) numbers. P is the principal component valued for that particular amino acid.

Three principal components comprising of approximately 90% of the physical properties in amino acids are used. Inclusion of more principal components are likely not useful given the overall error in the predictions. Hence the first protein is represented as:

$A=[P1_{aa1}P1_{aa2}\ .\ .\ .\ P1_{aaN}\ P2_{aa1}\ P2_{aa2}\ .\ .\ .\ P2_{aaN}\ P3_{aa1}\ P3_{aa2}\ .\ .\ .\ P3_{aaN}]$

And the second protein is represented as:

$B=[P1_{aa1}P1_{aa2}\ .\ .\ .\ P1_{aaM}\ P2_{aa1}\ P2_{aa2}\ .\ .\ .\ P2_{aaM}\ P3_{aa1}\ P3_{aa2}\ .\ .\ .\ P3_{aaM}]$

Step 2: Matrix multiplication of the two vectors produces a 45×45 matrix (for each 15-mer). The diagonal elements contain the Euclidian distance between the physical properties of each of the amino acids. Identical amino acids produce a zero on the diagonal. The "Trace" (sum of the diagonal elements) of the matrix is a metric for the overall distance between the two peptides that embodies approximately 90% of the physical properties of the peptide. The smaller the Euclidian distance between the peptides the more similar they are. The off-diagonal elements, while having meaning are not used in further calculations.

Step 3: Step 2 is repeated, pairwise, for all peptides producing an N×M matrix of distances between all pairs of peptides Step 4: The N×M matrix is scanned and the peptides with minimum distance between them are retrieved. The columns are scanned and the row with the minimum distance is obtained—the single peptide pair that are the most similar. Note that for a pair of proteins with 500 amino acids each this will be a matrix with 250,000 elements.

Step 5: A vector is created from the diagonal elements of the distance matrix of the selected peptide pairs. These vectors are then multiplied (element by element) with the VIP (variable importance projection) vector for each of the different MHC molecules. This process applies a weighting factor to the distance matrix for each of the alleles as each has different patterns of importance for different amino acids in the binding.

Step 6: The matrix multiplication process is repeated using the predicted MHC binding affinity metrics as input vectors. This produces a Distance matrix the diagonal elements of which are the similarity of the binding of the two peptides to a particular HLA allele.

Step 7: The output from the processes are combined and pairs of peptides that have similar high affinity MHC binding and physical similarity. Additionally, the count of the identical amino acids in the peptide is used as a metric in combination with the above. Very few peptides are conserved through this process and those which do are likely mimic suspects.

Honeyman et al., Evidence for molecular mimicry between human T cell epitopes in rotavirus and pancreatic islet autoantigens. J Immunol 2010, 184:2204-2210, have suggested a mimic relationship between rotavirus VP7 and two proteins associated with diabetes which are components of pancreatic metabolism in the islet of Langerhans cells, of tyrosine phosphatase-like insulinoma Ag 2 (IA2) and glutamic acid decarboxylase 65 (GAD65).

In one specific application we applied the above process to detection of peptides in VP7 which serve as potential mimics in IA2. This process is depicted in FIG. 37. Multiple isoforms of IA2 were included but emerged as the same pattern. All possible peptides in IA2 (978) were matched against all possible peptides in VP7(325). Peptides within the top 10% closest similarity (170) were identified. This was reduced to 56 by elimination of those which are not intracellular (in concordance with Honeyman's experimental data). Patterns of high affinity binding to MHC molecules were identified and those which had high binding to 2 or more HLAs were identified. The resultant 10 peptides are identified as potential mimics. Seven of ten identified are coincident with the VP7 segment identified by Honeyman. Hence, from 317,850 possible combinations, seven were identified which represent one contiguous stretch of VP7 and coincide with the epitope experimentally defined by Honeyman.

Example 12

Epitope Mapping in Vaccinia Virus

Figure 38:
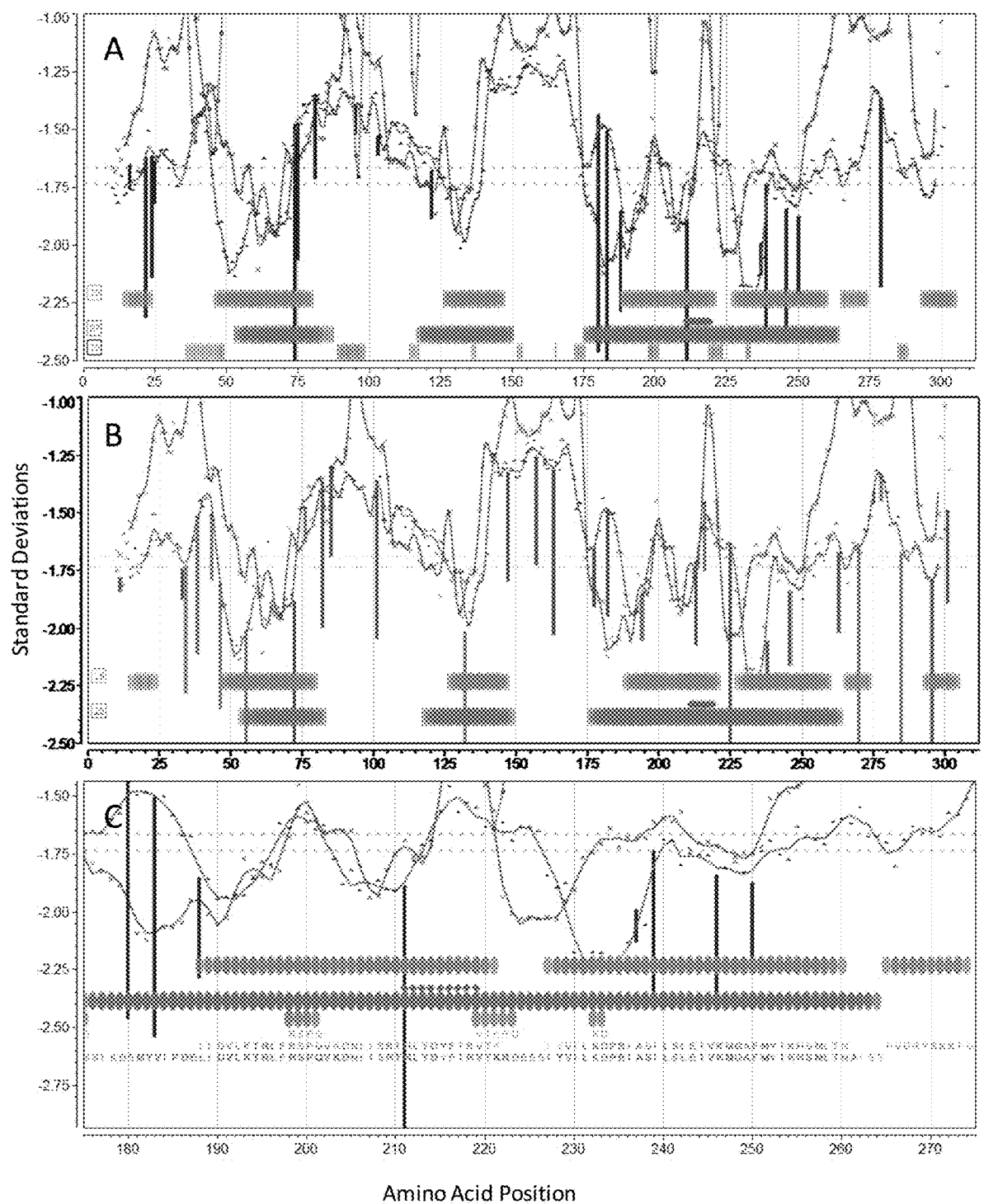

The complete proteome for VACV Western Reserve was downloaded from Genbank and processed as described herein. We generated graphical output for all the proteins and then compared the output for proteins reported as containing immunodominant binding T-cell epitopes. FIG. 38 shows graphical output for I1L (GI:68275867). FIG. 39 shows comparable output for proteins A10L (GI:68275926), The experimental studies by Pasquetto et al. (2005) J Immunol 175: 5504-5515, to which we made comparisons, were done in transgenic mice carrying human MHC-I molecules. Thus they represent perhaps the most clear attempt to match in silico predicted to experimental human MHC binding. FIG. 38 depicts plots for protein I1L shown at two different magnifications, to enable the visualization of peptide sequences in the overlays. As L lacks transmembrane domains the background has been left uncolored. The colored vertical lines indicate the specific location of the leading edge (N-terminus of a 9-mer) of predicted high affinity peptides for the particular indicated HLA. The colored lines extend below the permuted population average and indicate that specific HLA shows higher affinity binding for that peptide than does the population as a whole. Also shown are the locations of predicted B-cell epitopes. Notably, the peptides experimentally mapped by Pasquetto et al. (and shown in FIG. 38 by red diamonds) are ones with predicted binding affinity of at least 2.5 standard deviations below the mean.

Protein I1L was reported to also contain a B-cell epitope and led to the suggestion that B-cell and T-cell epitopes being deterministically linked within the same protein. Sette et al. (2008) Immunity 28: 847-858. S1074-7613(08)00235-5. Based on the permuted population phenotype, we predict MHC-I and MHC-II high affinity binding peptides, and multiple B-cell epitopes, affiliated in three CEGs. The predictions for each HLA used in transgenic mice by Pasquetto et al. were examined. HLA-A*0201 (FIG. 38A and at higher resolution in 38C) shows a peak of very high affinity binding for the aa 211-219 peptide RLYDYFTRV, a remarkable 3.95 deviations below the mean. The predicted initial amino acid of this peak binding coincides exactly with the initial arginine in the 9-mer described by Pasquetto et al. Interestingly, we also predict that HLA-A*0201 mice should detect binding of a similar high affinity starting at amino acid 74. As there are ten B-cell binding regions in the top 25% probability, any one or a combination of these could account for the linked epitope response noted by Sette et al., however a group of three predicted B-cell epitopes lie within positions 198-233. FIG. 38B shows the binding affinities predicted for HLA-A*1101 and HLA-B*0702. There are also high peaks of affinity, but not coincident with those of HLA-A*0201.

Example 13

The complete proteome sequences for a number of bacteria and protozoa were downloaded from patricbrc.org or Genbank and analyzed according to the methods described herein. High affinity MHC-I and MHC-II binding peptides and high probability B cell epitope sequences were determined.

MHC I and MHC II binding data were first standardized to zero mean and unit variance and then for each peptide in the protein sequence the highest binding affinity of combinations of allelic pairs was computed. Finally all possible combinations of alleles were averaged to represent a population phenotype for each particular peptide in the protein sequence. The population-permuted metric over protein sequences was found to be normally distributed and the peptides selected covered regions within the proteins of predicted highest affinity within that protein—the tenth percentile and one percentile highest affinity peptides. BEPI regions were selected based on the 25th percentile Bayesian probability for predicted B-cell epitopes based on a NN predictor trained with a large dataset of BepiPred 1.0 output for 100 randomly selected proteins.

Two tables summarize the output: Tables 14 A and B shows the number of peptides identified which fulfill the criteria established. Table 14A includes output for *Mycobacterium* species and *Staphylococcal* species, Table 14 B includes output for several protozoal species. Table 15 summarizes how many of the peptides identified were conserved in multiple strains of *Mycobacterium* or *Staphylococcus* and the number of instances of each level of conservation.

TABLEs 14A

MHC-I and MHC-II denote the tenth percentile highest affinity binding; MHC-I top 1% and MHC-II top 1% denote the one percentile highest affinity binding. Sequence numbers correspond to the SEQ ID Listing accompanying the application.

| Species | Sub group | Class | Type | Number | First Seq No | Last Seq No |
|---|---|---|---|---|---|---|
| *Mycobacterium avium* 104 | A | Membrane | BEPI | 10388 | 1 | 10388 |
| *Mycobacterium avium* subsp. *avium* ATCC 25291 | | | MHC-I | 8095 | 10389 | 18483 |
| *Mycobacterium avium* subsp. *paratuberculosis* K-10 | | | MHC-I top 1% | 1755 | 18484 | 20238 |
| 3 strains | | | MHC-II | 5513 | 20239 | 25751 |
| | | | MHC-II top 1% | 958 | 25752 | 26709 |
| | | Other | BEPI | 50544 | 26710 | 77253 |
| | | | MHC-I | 30101 | 77254 | 107354 |
| | | | MHC-I top 1% | 5483 | 107355 | 112837 |
| | | | MHC-II | 21385 | 112838 | 134222 |
| | | | MHC-II top 1% | 2488 | 134223 | 136710 |
| | | Secreted | BEPI | 6141 | 136711 | 142851 |
| | | | MHC-I | 3169 | 142852 | 146020 |
| | | | MHC-I top 1% | 598 | 146021 | 146618 |
| | | | MHC-II | 2296 | 146619 | 148914 |
| | | | MHC-II top 1% | 293 | 148915 | 149207 |
| *Mycobacterium bovis* AF2122/97 | B | Membrane | BEPI | 6712 | 149208 | 155919 |
| *Mycobacterium bovis* BCG str. Pasteur 1173P2 | | | MHC-I | 4825 | 155920 | 160744 |
| *Mycobacterium bovis* BCG str. Tokyo 172 | | | MHC-I top op 1% | 950 | 160745 | 161694 |
| (3 strains) | | | MHC-II | 3313 | 161695 | 165007 |
| | | | MHC-II top 1% | 571 | 165008 | 165578 |
| | | Other | BEPI | 29716 | 165579 | 195294 |
| | | | MHC-I | 16799 | 195295 | 212093 |
| | | | MHC-I top 1% | 3077 | 212094 | 215170 |
| | | | MHC-II | 11995 | 215171 | 227165 |
| | | | MHC-II top 1% | 1500 | 227166 | 228665 |
| | | Secreted | BEPI | 4376 | 228666 | 233041 |
| | | | MHC-I | 2403 | 233042 | 235444 |
| | | | MHC-I top 1% | 602 | 235445 | 236046 |
| | | | MHC-II | 1774 | 236047 | 237820 |
| | | | MHC-II top 1% | 282 | 237821 | 238102 |
| *Mycobacterium abscessus* | C | Membrane | BEPI | 57939 | 238103 | 296041 |
| *Mycobacterium gilvum* PYR-GCK | | | MHC-I | 42605 | 296042 | 338646 |
| *Mycobacterium intracellulare* ATCC 13950 | | | MHC-I top 1% | 8842 | 338647 | 347488 |
| *Mycobacterium kansasii* ATCC 12478 | | | | | | |
| *Mycobacterium marinum* M | | | MHC-II | 28363 | 347489 | 375851 |
| *Mycobacterium parascrofulaceum* ATCC BAA-614 | | | MHC-II top 1% | 4784 | 375852 | 380635 |
| *Mycobacterium smegmatis* str. MC2 155 | | | | | | |
| (7 strains) | | Other | BEPI | 237644 | 380636 | 618279 |
| | | | MHC-I | 139484 | 618280 | 757763 |
| | | | MHC-I top 1% | 24748 | 757764 | 782511 |
| | | | MHC-II | 97442 | 782512 | 879953 |
| | | | MHC-II top 1% | 11018 | 879954 | 890971 |
| | | Secreted | BEPI | 31949 | 890972 | 922920 |
| | | | MHC-I | 15770 | 922921 | 938690 |
| | | | MHC-I top 1% | 3133 | 938691 | 941823 |
| | | | MHC-II | 10830 | 941824 | 952653 |
| | | | MHC-II top 1% | 1400 | 952654 | 954053 |
| *Mycobacterium leprae* Br4923 | D | Membrane | BEPI | 11527 | 954054 | 965580 |
| *Mycobacterium leprae* TN | | | MHC-I | 8120 | 965581 | 973700 |
| *Mycobacterium ulcerans* Agy99 | | | MHC-I top 1% | 1591 | 973701 | 975291 |
| (3 strains) | | | MHC-II | 5263 | 975292 | 980554 |
| | | | MHC-II top 1% | 844 | 980555 | 981398 |
| | | Other | BEPI | 50745 | 981399 | 1032143 |
| | | | MHC-I | 26911 | 1032144 | 1059054 |
| | | | MHC-I top 1% | 4793 | 1059055 | 1063847 |

TABLEs 14A-continued

MHC-I and MHC-II denote the tenth percentile highest affinity binding; MHC-I top 1% and MHC-II top 1% denote the one percentile highest affinity binding. Sequence numbers correspond to the SEQ ID Listing accompanying the application.

| Species | Sub group | Class | Type | Number | First Seq No | Last Seq No |
|---|---|---|---|---|---|---|
| | | | MHC-II | 18377 | 1063848 | 1082224 |
| | | | MHC-II top 1% | 1956 | 1082225 | 1084180 |
| | | Secreted | BEPI | 5426 | 1084181 | 1089606 |
| | | | MHC-I | 2645 | 1089607 | 1092251 |
| | | | MHC-I top 1% | 556 | 1092252 | 1092807 |
| | | | MHC-II | 1756 | 1092808 | 1094563 |
| | | | MHC-II top 1% | 231 | 1094564 | 1094794 |
| Mycobacterium sp. JLS | E | Membrane | BEPI | 20292 | 1094795 | 1115086 |
| Mycobacterium sp. KMS | | | MHC-I | 14936 | 1115087 | 1130022 |
| Mycobacterium sp. MCS | | | MHC-I top 1% | 3093 | 1130023 | 1133115 |
| Mycobacterium vanbaalenii PYR-1 | | | | | | |
| (4 strains) | | | MHC-II | 10185 | 1133116 | 1143300 |
| | | | MHC-II top 1% | 1707 | 1143301 | 1145007 |
| | | Other | BEPI | 90183 | 1145008 | 1235190 |
| | | | MHC-I | 51070 | 1235191 | 1286260 |
| | | | MHC-I top 1% | 9132 | 1286261 | 1295392 |
| | | | MHC-II | 35859 | 1295393 | 1331251 |
| | | | MHC-II top 1% | 4072 | 1331252 | 1335323 |
| | | Secreted | BEPI | 12856 | 1335324 | 1348179 |
| | | | MHC-I | 6586 | 1348180 | 1354765 |
| | | | MHC-I top 1% | 1344 | 1354766 | 1356109 |
| | | | MHC-II | 4426 | 1356110 | 1360535 |
| | | | MHC-II top 1% | 564 | 1360536 | 1361099 |
| Mycobacterium tuberculosis 02_1987 | F | Membrane | BEPI | 12321 | 1361100 | 1373420 |
| Mycobacterium tuberculosis 210 | | | MHC-I | 10877 | 1373421 | 1384297 |
| Mycobacterium tuberculosis 94_M4241A | | | MHC-I top 1% | 2368 | 1384298 | 1386665 |
| Mycobacterium tuberculosis '98-R604 INH-RIF-EM' | | | | | | |
| Mycobacterium tuberculosis C | | | MHC-II | 7539 | 1386666 | 1394204 |
| Mycobacterium tuberculosis CPHL_A | | | MHC-II top 1% | 1294 | 1394205 | 1395498 |
| Mycobacterium tuberculosis EAS054 | | | | | | |
| Mycobacterium tuberculosis F11 | | Other | BEPI | 57651 | 1395499 | 1453149 |
| Mycobacterium tuberculosis GM 1503 | | | MHC-I | 41229 | 1453150 | 1494378 |
| Mycobacterium tuberculosis H37Ra | | | MHC-I | 8481 | 1494379 | 1502859 |
| Mycobacterium tuberculosis H37Ra [WGS] | | | top 1% | | | |
| Mycobacterium tuberculosis H37Rv | | | MHC-II | 29270 | 1502860 | 1532129 |
| Mycobacterium tuberculosis K85 | | | MHC-II | 3646 | 1532130 | 1535775 |
| Mycobacterium tuberculosis KZN 1435 | | | top 1% | | | |
| Mycobacterium tuberculosis KZN 4207 | | Secreted | BEPI | 10317 | 1535776 | 1546092 |
| Mycobacterium tuberculosis KZN 605 | | | MHC-I | 6355 | 1546093 | 1552447 |
| Mycobacterium tuberculosis KZN R506 | | | MHC-I | 1610 | 1552448 | 1554057 |
| Mycobacterium tuberculosis KZN V2475 | | | top 1% | | | |
| Mycobacterium tuberculosis str. Haarlem | | | MHC-II | 4434 | 1554058 | 1558491 |
| Mycobacterium tuberculosis T17 | | | MHC-II | 689 | 1558492 | 1559180 |
| Mycobacterium tuberculosis T46 | | | top 1% | | | |
| Mycobacterium tuberculosis T85 | | | | | | |
| Mycobacterium tuberculosis T92 | | | | | | |
| (23 strains) | | | | | | |
| Staphylococcus_aureus_04-02981 | A | Membrane | BEPI | 13685 | 1559181 | 1572865 |
| Staphylococcus_aureus_930918-3 | | | MHC-I | 12671 | 1572866 | 1585536 |
| Staphylococcus_aureus_A10102 | | | MHC-I | 2914 | 1585537 | 1588450 |
| Staphylococcus_aureus_A5937 | | | top 1% | | | |
| Staphylococcus_aureus_A5948 | | | MHC-II | 9810 | 1588451 | 1598260 |
| Staphylococcus_aureus_A6224 | | | MHC-II | 1785 | 1598261 | 1600045 |
| Staphylococcus_aureus_A6300 | | | top 1% | | | |
| Staphylococcus_aureus_A8115 | | Other | BEPI | 45539 | 1600046 | 1645584 |
| Staphylococcus_aureus_A8117 | | | MHC-I | 28946 | 1645585 | 1674530 |
| Staphylococcus_aureus_A8796 | | | MHC-I | 4959 | 1674531 | 1679489 |
| Staphylococcus_aureus_A8819 | | | top 1% | | | |
| Staphylococcus_aureus_A9299 | | | MHC-II | 21849 | 1679490 | 1701338 |
| Staphylococcus_aureus_A9635 | | | MHC-II | 2092 | 1701339 | 1703430 |
| Staphylococcus_aureus_A9719 | | | top 1% | | | |
| Staphylococcus_aureus_A9754 | | Secreted | BEPI | 9602 | 1703431 | 1713032 |
| Staphylococcus_aureus_A9763 | | | MHC-I | 5647 | 1713033 | 1718679 |
| Staphylococcus_aureus_A9765 | | | MHC-I | 1225 | 1718680 | 1719904 |
| Staphylococcus_aureus_A9781 | | | top 1% | | | |

TABLEs 14A-continued

MHC-I and MHC-II denote the tenth percentile highest affinity binding; MHC-I top 1% and MHC-II top 1% denote the one percentile highest affinity binding. Sequence numbers correspond to the SEQ ID Listing accompanying the application.

| Species | Sub group | Class | Type | Number | First Seq No | Last Seq No |
|---|---|---|---|---|---|---|
| *Staphylococcus_aureus_*D30 | | | MHC-II | 4310 | 1719905 | 1724214 |
| *Staphylococcus_aureus_*RF122 | | | MHC-II top 1% | 829 | 1724215 | 1725043 |
| *Staphylococcus_aureus_subsp_aureus_*132 | | | | | | |
| *Staphylococcus_aureus_subsp_aureus_*552053 | | | | | | |
| *Staphylococcus_aureus_subsp_aureus_*58-424 | | | | | | |
| *Staphylococcus_aureus_subsp_aureus_*65-1322 | | | | | | |
| *Staphylococcus_aureus_subsp_aureus_*68-397 | | | | | | |
| *Staphylococcus_aureus_subsp_aureus_*A01793497 | | | | | | |
| *Staphylococcus_aureus_subsp_aureus_*Btn1260 | | | | | | |
| *Staphylococcus_aureus_subsp_aureus_*C101 | | | | | | |
| *Staphylococcus_aureus_subsp_aureus_*C160 | | | | | | |
| *Staphylococcus_aureus_subsp_aureus_*C427 | | | | | | |
| *Staphylococcus_aureus_subsp_aureus_*COL | | | | | | |
| *Staphylococcus_aureus_subsp_aureus_*D139 | | | | | | |
| *Staphylococcus_aureus_subsp_aureus_*E1410 | | | | | | |
| *Staphylococcus_aureus_subsp_aureus_*ED98 | | | | | | |
| *Staphylococcus_aureus_subsp_aureus_*EMRSA16 | | | | | | |
| *Staphylococcus_aureus_subsp_aureus_*H19 | | | | | | |
| *Staphylococcus_aureus_subsp_aureus_*JH1 | | | | | | |
| *Staphylococcus_aureus_subsp_aureus_*JH9 | | | | | | |
| *Staphylococcus_aureus_subsp_aureus_*M1015 | | | | | | |
| *Staphylococcus_aureus_subsp_aureus_*M809 | | | | | | |
| *Staphylococcus_aureus_subsp_aureus_*M876 | | | | | | |
| *Staphylococcus_aureus_subsp_aureus_*M899 | | | | | | |
| *Staphylococcus_aureus_subsp_aureus_*MN8 | | | | | | |
| *Staphylococcus_aureus_subsp_aureus_*MR1 | | | | | | |
| *Staphylococcus_aureus_subsp_aureus_*MRSA252 | | | | | | |
| *Staphylococcus_aureus_subsp_aureus_*MSSA476 | | | | | | |
| *Staphylococcus_aureus_subsp_aureus_*MW2 | | | | | | |
| *Staphylococcus_aureus_subsp_aureus_*Mu3 | | | | | | |
| *Staphylococcus_aureus_subsp_aureus_*Mu50 | | | | | | |
| *Staphylococcus_aureus_subsp_aureus_*Mu50-omega | | | | | | |
| *Staphylococcus_aureus_subsp_aureus_*N315 | | | | | | |
| *Staphylococcus_aureus_subsp_aureus_*NCTC_8325 | | | | | | |
| *Staphylococcus_aureus_subsp_aureus_*TCH130 | | | | | | |
| *Staphylococcus_aureus_subsp_aureus_*TCH60 | | | | | | |
| *Staphylococcus_aureus_subsp_aureus_*TCH70 | | | | | | |
| *Staphylococcus_aureus_subsp_aureus_*USA300_FPR3757 | | | | | | |
| *Staphylococcus_aureus_subsp_aureus_*USA300_TCH1516 | | | | | | |
| *Staphylococcus_aureus_subsp_aureus_*USA300_TCH959 | | | | | | |
| *Staphylococcus_aureus_subsp_aureus_*WBG10049 | | | | | | |
| *Staphylococcus_aureus_subsp_aureus_*WW270397 | | | | | | |
| *Staphylococcus_aureus_subsp_aureus_*str_CF-Marseille | | | | | | |
| *Staphylococcus_aureus_subsp_aureus_*str_JKD6008 | | | | | | |
| *Staphylococcus_aureus_subsp_aureus_*str_JKD6009 | | | | | | |
| *Staphylococcus_aureus_subsp_aureus_*str_Newman (64 strains) | | | | | | |
| *Staphylococcus_epidermidis* | B | Membrane | BEPI | 11442 | 1725044 | 1736485 |
| *Staphylococcus_epidermidis_*ATCC_12228 | | | MHC-I | 9429 | 1736486 | 1745914 |
| *Staphylococcus_epidermidis_*BCM-HMP0060 | | | MHC-I top 1% | 1888 | 1745915 | 1747802 |
| *Staphylococcus_epidermidis_*M23864-W1 | | | | | | |
| *Staphylococcus_epidermidis_*M23864-W2grey | | | MHC-II | 6427 | 1747803 | 1754229 |
| *Staphylococcus_epidermidis_*RP62A | | | MHC-II top 1% | 1137 | 1754230 | 1755366 |
| *Staphylococcus_epidermidis_*SK135 | | | | | | |
| *Staphylococcus_epidermidis_*W23144 (8 strains) | | Other | BEPI | 37987 | 1755367 | 1793353 |
| | | | MHC-I | 22000 | 1793354 | 1815353 |
| | | | MHC-I top 1% | 3644 | 1815354 | 1818997 |
| | | | MHC-II | 15137 | 1818998 | 1834134 |
| | | | MHC-II top 1% | 1334 | 1834135 | 1835468 |
| | | Secreted | BEPI | 4133 | 1835469 | 1839601 |
| | | | MHC-I | 1938 | 1839602 | 1841539 |
| | | | MHC-I top 1% | 394 | 1841540 | 1841933 |
| | | | MHC-II | 1403 | 1841934 | 1843336 |
| | | | MHC-II top 1% | 225 | 1843337 | 1843561 |
| *Staphylococcus_capitis_*SK14 | C | Membrane | BEPI | 25239 | 1843562 | 1868800 |
| *Staphylococcus_carnosus_subsp_carnosus_*TM300 | | | MHC-I | 21165 | 1868801 | 1889965 |
| *Staphylococcus_haemolyticus_*JCSC1435 | | | MHC-I top 1% | 4034 | 1889966 | 1893999 |
| *Staphylococcus_hominis_*SK119 | | | | | | |

TABLEs 14A-continued

MHC-I and MHC-II denote the tenth percentile highest affinity binding; MHC-I top 1% and MHC-II top 1% denote the one percentile highest affinity binding. Sequence numbers correspond to the SEQ ID Listing accompanying the application.

| Species | Sub group | Class | Type | Number | First Seq No | Last Seq No |
|---|---|---|---|---|---|---|
| *Staphylococcus_lugdunensis*_HKU09-01 | | | MHC-II | 13507 | 1894000 | 1907506 |
| *Staphylococcus_saprophyticus*_subsp_*saprophyticus*_ATCC_15305 | | | MHC-II top 1% | 2148 | 1907507 | 1909654 |
| *Staphylococcus_warneri*_L37603 | | | | | | |
| (7 strains) | | Other | BEPI | 88452 | 1909655 | 1998106 |
| | | | MHC-I | 50182 | 1998107 | 2048288 |
| | | | MHC-I top 1% | 8324 | 2048289 | 2056612 |
| | | | MHC-II | 33639 | 2056613 | 2090251 |
| | | | MHC-II top 1% | 2968 | 2090252 | 2093219 |
| | | Secreted | BEPI | 9262 | 2093220 | 2102481 |
| | | | MHC-I | 4275 | 2102482 | 2106756 |
| | | | MHC-I top 1% | 907 | 2106757 | 2107663 |
| | | | MHC-II | 2973 | 2107664 | 2110636 |
| | | | MHC-II top 1% | 459 | 2110637 | 2111095 |

TABLE 14 B

| Species | Class | Type | Number | First Seq_No | Last Seq_No |
|---|---|---|---|---|---|
| *Cryptosporidium hominus* | Membrane | BEPI | 10848 | 2111096 | 2121943 |
| | | MHC-I | 6957 | 2121944 | 2128900 |
| | | MHC-I top 1% | 931 | 2128901 | 2129831 |
| | | MHC-II | 4595 | 2129832 | 2134426 |
| | | MHC-II top 1% | 643 | 2134427 | 2135069 |
| | Other | BEPI | 32928 | 2135070 | 2167997 |
| | | MHC-I | 16832 | 2167998 | 2184829 |
| | | MHC-I top 1% | 2291 | 2184830 | 2187120 |
| | | MHC-II | 12449 | 2187121 | 2199569 |
| | | MHC-II top 1% | 1216 | 2199570 | 2200785 |
| | Secreted | BEPI | 5339 | 2200786 | 2206124 |
| | | MHC-I | 2616 | 2206125 | 2208740 |
| | | MHC-I top 1% | 299 | 2208741 | 2209039 |
| | | MHC-II | 1854 | 2209040 | 2210893 |
| | | MHC-II top 1% | 249 | 2210894 | 2211142 |
| *Cryptosporidium parvum* | Membrane | BEPI | 17708 | 2211143 | 2228850 |
| | | MHC-I | 11228 | 2228851 | 2240078 |
| | | MHC-I top 1% | 1452 | 2240079 | 2241530 |
| | | MHC-II | 7637 | 2241531 | 2249167 |
| | | MHC-II top 1% | 968 | 2249168 | 2250135 |
| | Other | BEPI | 38479 | 2250136 | 2288614 |
| | | MHC-I | 19127 | 2288615 | 2307741 |
| | | MHC-I top 1% | 2672 | 2307742 | 2310413 |
| | | MHC-II | 14294 | 2310414 | 2324707 |
| | | MHC-II top 1% | 1439 | 2324708 | 2326146 |
| | Secreted | BEPI | 7700 | 2326147 | 2333846 |
| | | MHC-I | 3767 | 2333847 | 2337613 |
| | | MHC-I top 1% | 443 | 2337614 | 2338056 |
| | | MHC-II | 2731 | 2338057 | 2340787 |
| | | MHC-II top 1% | 337 | 2340788 | 2341124 |
| *Cryptosporidium parvum* chromosome 6 | Membrane | BEPI | 2463 | 2341125 | 2343587 |
| | | MHC-I | 1616 | 2343588 | 2345203 |
| | | MHC-I top 1% | 247 | 2345204 | 2345450 |
| | | MHC-II | 1055 | 2345451 | 2346505 |
| | | MHC-II top 1% | 155 | 2346506 | 2346660 |
| | Other | BEPI | 5111 | 2346661 | 2351771 |
| | | MHC-I | 2586 | 2351772 | 2354357 |
| | | MHC-I top 1% | 361 | 2354358 | 2354718 |
| | | MHC-II | 1904 | 2354719 | 2356622 |
| | | MHC-II top 1% | 200 | 2356623 | 2356822 |
| | Secreted | BEPI | 775 | 2356823 | 2357597 |
| | | MHC-I | 361 | 2357598 | 2357958 |
| | | MHC-I top 1% | 59 | 2357959 | 2358017 |
| | | MHC-II | 299 | 2358018 | 2358316 |
| | | MHC-II top 1% | 34 | 2358317 | 2358350 |
| *Entamoeba dispar* | Membrane | BEPI | 21116 | 2358351 | 2379466 |
| | | MHC-I | 13507 | 2379467 | 2392973 |
| | | MHC-I top 1% | 2135 | 2392974 | 2395108 |
| | | MHC-II | 8333 | 2395109 | 2403441 |
| | | MHC-II top 1% | 1329 | 2403442 | 2404770 |
| | Other | BEPI | 67772 | 2404771 | 2472542 |
| | | MHC-I | 38825 | 2472543 | 2511367 |
| | | MHC-I top 1% | 6053 | 2511368 | 2517420 |
| | | MHC-II | 27208 | 2517421 | 2544628 |
| | | MHC-II top 1% | 3102 | 2544629 | 2547730 |
| | Secreted | BEPI | 5163 | 2547731 | 2552893 |
| | | MHC-I | 2367 | 2552894 | 2555260 |
| | | MHC-I top 1% | 342 | 2555261 | 2555602 |
| | | MHC-II | 1752 | 2555603 | 2557354 |
| | | MHC-II top 1% | 193 | 2557355 | 2557547 |
| *Entamoeba histolytica* | Membrane | BEPI | 20747 | 2557548 | 2578294 |
| | | MHC-I | 12289 | 2578295 | 2590583 |
| | | MHC-I top 1% | 1572 | 2590584 | 2592155 |
| | | MHC-II | 8153 | 2592156 | 2600308 |
| | | MHC-II top 1% | 1158 | 2600309 | 2601466 |
| | Other | BEPI | 66099 | 2601467 | 2667565 |
| | | MHC-I | 34272 | 2667566 | 2701837 |
| | | MHC-I top 1% | 4200 | 2701838 | 2706037 |
| | | MHC-II | 25516 | 2706038 | 2731553 |
| | | MHC-II top 1% | 2676 | 2731554 | 2734229 |

TABLE 14 B-continued

| Species | Class | Type | Number | First Seq_No | Last Seq_No |
|---|---|---|---|---|---|
| | | Secreted BEPI | 4645 | 2734230 | 2738874 |
| | | MHC-I | 1986 | 2738875 | 2740860 |
| | | MHC-I top 1% | 263 | 2740861 | 2741123 |
| | | MHC-II | 1586 | 2741124 | 2742709 |
| | | MHC-II top 1% | 166 | 2742710 | 2742875 |
| Entamoeba invadens | Membrane | BEPI | 41984 | 2742876 | 2784859 |
| | | MHC-I | 24975 | 2784860 | 2809834 |
| | | MHC-I top 1% | 3862 | 2809835 | 2813696 |
| | | MHC-II | 15914 | 2813697 | 2829610 |
| | | MHC-II top 1% | 2515 | 2829611 | 2832125 |
| | Other | BEPI | 92397 | 2832126 | 2924522 |
| | | MHC-I | 53758 | 2924523 | 2978280 |
| | | MHC-I top 1% | 8907 | 2978281 | 2987187 |
| | | MHC-II | 38002 | 2987188 | 3025189 |
| | | MHC-II top 1% | 4670 | 3025190 | 3029859 |
| | Secreted | BEPI | 9269 | 3029860 | 3039128 |
| | | MHC-I | 4538 | 3039129 | 3043666 |
| | | MHC-I top 1% | 680 | 3043667 | 3044346 |
| | | MHC-II | 3212 | 3044347 | 3047558 |
| | | MHC-II top 1% | 390 | 3047559 | 3047948 |
| Giardia lambia (intestinalis) | Membrane | BEPI | 20675 | 3047949 | 3068623 |
| | | MHC-I | 13931 | 3068624 | 3082554 |
| | | MHC-I top 1% | 2485 | 3082555 | 3085039 |
| | | MHC-II | 9132 | 3085040 | 3094171 |
| | | MHC-II top 1% | 1532 | 3094172 | 3095703 |
| | Other | BEPI | 52171 | 3095704 | 3147874 |
| | | MHC-I | 28388 | 3147875 | 3176262 |
| | | MHC-I top 1% | 4997 | 3176263 | 3181259 |
| | | MHC-II | 20098 | 3181260 | 3201357 |
| | | MHC-II top 1% | 2513 | 3201358 | 3203870 |
| | Secreted | BEPI | 2267 | 3203871 | 3206137 |
| | | MHC-I | 1301 | 3206138 | 3207438 |
| | | MHC-I top 1% | 185 | 3207439 | 3207623 |
| | | MHC-II | 904 | 3207624 | 3208527 |
| | | MHC-II top 1% | 116 | 3208528 | 3208643 |
| Plasmodium falciparum | Membrane | BEPI | 45736 | 3208644 | 3254379 |
| | | MHC-I | 25185 | 3254380 | 3279564 |
| | | MHC-I top 1% | 2320 | 3279565 | 3281884 |
| | | MHC-II | 17293 | 3281885 | 3299177 |
| | | MHC-II top 1% | 1570 | 3299178 | 3300747 |
| | Other | BEPI | 51376 | 3300748 | 3352123 |
| | | MHC-I | 24406 | 3352124 | 3376529 |
| | | MHC-I top 1% | 2455 | 3376530 | 3378984 |
| | | MHC-II | 17697 | 3378985 | 3396681 |
| | | MHC-II top 1% | 1230 | 3396682 | 3397911 |
| | Secreted | BEPI | 5070 | 3397912 | 3402981 |
| | | MHC-I | 2307 | 3402982 | 3405288 |
| | | MHC-I top 1% | 166 | 3405289 | 3405454 |
| | | MHC-II | 1698 | 3405455 | 3407152 |
| | | MHC-II top 1% | 140 | 3407153 | 3407292 |

TABLE 15

| Number | Epitopes | Percent |
|---|---|---|
| *Staphylococcus* BEPI | | |
| 1-10 | 211,876 | 86.3598% |
| 11-20 | 7,586 | 3.0920% |
| 21-30 | 4,848 | 1.9760% |
| 31-40 | 3,868 | 1.5766% |
| 41-50 | 1,969 | 0.8026% |
| 51-60 | 10,755 | 4.3837% |
| 61-70 | 4,271 | 1.7408% |
| >70 | 168 | 0.0685% |
| | 245,341 | 100.0000% |
| *Staphylococcus* MHC-I | | |
| 1-10 | 137,013 | 87.6866% |
| 11-20 | 5,420 | 3.4687% |
| 21-30 | 3,081 | 1.9718% |
| 31-40 | 2,496 | 1.5974% |
| 41-50 | 1,324 | 0.8473% |
| 51-60 | 5,302 | 3.3932% |
| 61-70 | 1,596 | 1.0214% |
| >70 | 21 | 0.0134% |
| | 156,253 | 100.0000% |
| *Staphylococcus* MHC-I top 1% | | |
| 1-10 | 24,732 | 87.4262% |
| 11-20 | 1,081 | 3.8213% |
| 21-30 | 600 | 2.1210% |
| 31-40 | 492 | 1.7392% |
| 41-50 | 268 | 0.9474% |
| 51-60 | 866 | 3.0613% |
| 61-70 | 246 | 0.8696% |
| >70 | 4 | 0.0141% |
| | 28,289 | 100.0000% |
| *Staphylococcus* MHC-II | | |
| 1-10 | 95,743 | 87.7933% |
| 11-20 | 3,981 | 3.6505% |
| 21-30 | 2,350 | 2.1549% |
| 31-40 | 1,889 | 1.7322% |
| 41-50 | 969 | 0.8885% |
| 51-60 | 3,267 | 2.9957% |
| 61-70 | 843 | 0.7730% |
| >70 | 13 | 0.0119% |
| | 109,055 | 100.0000% |
| *Staphylococcus* MHC-II top 1% | | |
| 1-10 | 11,452 | 88.2484% |
| 11-20 | 560 | 4.3153% |
| 21-30 | 273 | 2.1037% |
| 31-40 | 208 | 1.6028% |
| 41-50 | 111 | 0.8554% |
| 51-60 | 311 | 2.3965% |
| 61-70 | 61 | 0.4701% |
| >70 | 1 | 0.0077% |
| | 12,977 | 100.0000% |
| Mycobacteria BEPI | | |
| 1-10 | 667,334 | 94.4260% |
| 11-20 | 18,200 | 2.5753% |
| 21-30 | 20,569 | 2.9105% |
| 31-40 | 263 | 0.0372% |
| >40 | 361 | 0.0511% |
| | 706,727 | 100.0000% |
| Mycobacteria MHC-I | | |
| 1-10 | 410,873 | 95.1139% |
| 11-20 | 11,199 | 2.5925% |
| 21-30 | 9,816 | 2.2723% |
| 31-40 | 40 | 0.0093% |
| >40 | 52 | 0.0120% |
| | 431,980 | 100.0000% |

TABLE 15-continued

| Number | Epitopes | Percent |
|---|---|---|
| Mycobacteria MHC-I top 1% | | |
| 1-10 | 78,274 | 95.2748% |
| 11-20 | 2,464 | 2.9992% |
| 21-30 | 1,406 | 1.7114% |
| 31-40 | 6 | 0.0073% |
| >40 | 6 | 0.0073% |
| | 82,156 | 100.0000% |
| Mycobacteria MHC-II | | |
| 1-10 | 285,443 | 95.1413% |
| 11-20 | 7,232 | 2.4105% |
| 21-30 | 7,292 | 2.4305% |
| 31-40 | 19 | 0.0063% |
| >40 | 34 | 0.0113% |
| | 300,020 | 100.0000% |
| Mycobacteria MHC-II top 1% | | |
| 1-10 | 36,476 | 97.2434% |
| 11-20 | 1,033 | 2.7539% |
| 21-30 | 1 | 0.0027% |
| 31-40 | — | 0.0000% |
| >40 | — | 0.0000% |
| | 37,510 | 100.0000% |

Conservation of B-Cell Epitopes and MHC Binding Peptides.

This table shows the number of times individual high affinity MHC-binding peptides and B-cell epitope sequences (as described above) are found conserved among the *Staphylococcus* strains evaluated (79 strains) or among the *Mycobacterium* strains evaluated (43 strains).

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention which are obvious to those skilled in the relevant fields are intended to be within the scope of the following claims.

SEQUENCE LISTING (331 sequences)

SEQ ID NO: 1 - DNA, 1958 bp, Homo sapiens
ccggctccaggagggacggcgtagctcgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacgggggagctttcccagagacccggggatggattggcctccagggcgcaggggagggtgcggcagggcaggagcttggcagagagatagccgggctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaaccaaactattttctaaataaacctttgtaatctaa

SEQ ID NO: 2 - DNA, 783 bp, Homo sapiens
agctcctaggtccctgtcctgtggaaatttgtggaccctgggcaccctctcttgctcccaaattttaatcggctcctggaaacctcaccccaaattggagataggcactcctcttgtagaacaaaaggctcaggttcagggagtgagggcctgaactgtgcccccaccctccaggaagggtccttcacggcctggctgcagggatcagtcacgtgtggcccttcattaggccctgccatataagccaagggcacggggtggccgggaactctctaggcaagaatcccggaggcagaggccatgctgaccgcagcggtgctgagctgtgccctgctgctggcactgcctgccacgcgaggagcccagatgggcttggcccccatggagggcatcagaaggcctgaccaggccctgctcccagagctcccaggcctgggcctgcgggccccactgaagaagacaactgcagaacaggcagaagaggatctgttgcaggaggctcaggccttggcagaggtactagacctgcaggaccgcgagccccgctcctcacgtcgctgcgtaaggctgcatgagtcctgcctgggacagcaggtgccttgctgtgacccatgtgccacgtgctactgccgcttcttcaatgccttctgctactgccgcaagctgggtactgccatgaatccctgcagccgcacctagctggccaacgtcagggtcggggctagggtaggggcaaggaaactcgaataaaggatgggaccaacaaaaaaaaaaaaaaaaaaa

SEQ ID NO: 3 - DNA, 4194 bp, Homo sapiens
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaaaaaaaaaaaaaaaaa

SEQ ID NO: 4 - DNA, 1864 bp, Homo sapiens
ctggcggctcttgggactggcggggctgcgcgcggggttagggtgggggtacgggaaggctcaacccaggacctgcgtaccttgctttgggggcgcactaagcacctgccgggagcagggggcgcaccgggaactcgcagatttcgccagttgggcgcactggggatctgtggactgcgtccgggggatgggctagggggacatgcgcacgctttgggccttacagaatgtgatcgcgcgagggggagggcgaagcgtggcgggagggcgaggcgaaggaaggagggcgtgagaaaggcgacggcggcggcgcggaggagggttatctatacatttaaaaaccagccgcctgcgccgcgcctgcggagacctgggagagtccggccgcacgcgcgggacacgagcgtcccacgctccctggcgcgtacggcctgccaccactaggcctcctatccccgggctccagacgacctaggacgcgtgccctggggagttgcctggcggcgccgtgccagaagcccccttggggcgccacagttttccccgtcgcctccggttcctctgcctgcaccttcctgcggcgcgccgggacctggagcgggcgggtggatgcaggcgcgatggacggcggcacactgcccaggtccgcgccccctgcgccccccgtccctgtcggctgcgctgcccggcggagacccgcgtccccggaactgttgcgctgcagccggcggcggcgaccggccaccgcagagaccggaggcggcgcagcggccgtagcgcggcgcaatgagcgcgagcgcaaccgcgtgaagctggtgaacttgggcttccaggcgctgcggcagcacgtgccgcacggcggcgccagcaagaagctgagcaaggtggagacgctgcgctcagccgtggagtacatccgcgcgctgcagcgcctgctggccgagcacgacgccgtgcgcaacgcgctggcgggagggctgaggccgcaggccgtgcggccgtctgcgccccgcgggccgccagggaccaccccggtcgccgcctcgccctcccgcgcttcttcgtccccgggccgcgggggcagctcggagcccggctccccgcgttccgcctactcgtcggacgacagcggctgcgaaggcgcgctgagtcctgcggagcgcgagctactcgacttctccagctggttagggggctactgagcgccctcgacctatgagcctcagccccggaagccgagcgagcggccggcgcgctcatcgccggggagcccgccaggtggaccggcccgcgctccgcccccagcgagccggggacccacccaccaccccccgcaccgccgacgccgcctcgttcgtccggcccagcctgaccaatgccgcggtggaaacgggcttggagctggccccataagggctggcggcttcctccgacgccgcccctccccacagcttctcgactgcagtggggcggggggcaccaacacttggagatttttccggaggggagaggattttctaagggcacagagaatccattttctacacattaacttgagctgctggagggacactgctggcaaacggagacctatttttgtacaaagaacccttgacctggggcgtaataaagatgacctggacccctgcccccactatctggagttttccatgctggccaagatctggacacgagcagtccctgaggggcggggtccctggcgtgaggcccccgtgacagcccaccctggggtgggtttgtgggcactgctgctctgctagggagaagcctgtgtggggcacacctcttcaagggagcgtgaactttataaataaatcagttctgtttaaaaaaaaaaaaaaaa

SEQ ID NO: 5 - DNA, 4760 bp, Homo sapiens
aaaatcccacgtgactggctctcctctcaggccatcatggcgtctcccagtgggaagggagcccgggcgctggaggctcctggctgcgggccccggccgctcgcccgggacctggtggactccgtggacgatgcggaggggctgtacgtggctgtggagcgctgcccgctgtgcaacactacccgccggcggctgacctgcgccaaatgcgttcagagcggcgatttcgtctacttcgacggccgcgaccgggagaggtttatcgacaagaaggaaaggttaagccgacttaagagcaagcaagaagaatttcagaaagaagtgttaaaagctatggaaggaaaatggataacagatcagttgagatggaaaataatgtcctgcaagatgaggattgaacagttaaaacaaacaatatgtaaaggaaatgaagaaatggagaaaaattctgaaggccttctcaaaaccaaggaaaagaatcagaagctttacagtcgagcacaacggcaccaagagaaaaaggagaagattcagaggcataatcgcaaacttggtgacctggtagaaaaaaagaccattgacttaagaagtcattatgagcgtctggcaaatcttcgacgatcccatatattagagctcacctctgtcatttttccaatcgaggaagtaaagacgggtgtgagagaccccgcagatgtgtcttcagagagtgacagtgccatgacctccagcactgtgagcaagcttgctgaagcccggaggacaacttacctctcaggacgatgggtctgtgacgatcacaacggagacaccagcattagcattacagggccttggattagcctccctaacaatggggactactctgcctactacagctgggtggaggagaagaaaacaacccaggggcctgacatggagcagagtaaccctgcctacaccatcagtgctgcgctgtgctatgcaactcagctggtcaacattctgtctcatatacttgatgtaaatcttcccaaaaagctctgcaacagtgaattttgtggcgaaaatctaagcaagcagaaatttactcgagcagtgaagaaactgaatgcaaatattctttacctttgtttttctcagcatgtaaatttagatcaattacaaccactgcataccctcaggaatctaatgtacctggtcagtccaagctctgaacacctaggcaggtcagggccctttgaagtacgagcagaccttgaggagtccatggaatttgtggatcccggagttgctggagaatcagatgagagcggagatgagcgcgtcagcgatgaagaaaccgacctgggcacagactgggagaacttgcctagtccccggttttgtgatatcccttcccagtctgtggaagtctcccagagtcagagcacccaggcgtccccacccatcgcgagcagcagtgcaggtgggatgatctcctctgcagcagcctcggtgacctcctggtttaaagcttacactggacaccgttaacgagcatggaccaaaacataccaaatctgcatcaagaaagttcttctcccactacactctagtaaacattttctgtttaagttaagatagtgtctggaacaaagaggttaaagtgttgttttgttttgtctttttaagcagggagacaaacatttctatttgccaagtggcctgtgatggtgaccaacatgcttatgataattaagagaacaggggtcgaaggtctttctacccagaccagtgctggtggaaggaggacctgtgcgtgtggccagttctgccaaggaagcagttgatttgggttccctctgggcccgggccaccgggcccacagatatgggtcagtgtgctggtccttgcggtgctgagactgttcctgacactttaagttttagaggttggttgaatcacaagaggtgattcttgattattaggacatgaaagataaaagctctttaataagagtttttctgccattgttttttgtatgagaaccagcaggcaatttaaaatttctaatttggtcctttgattttgtttgggaggggtgagttacacgtattttattcatgctgctctgtcgtagtttgtcagacattcctgtttttctttcccccacacaccaaagaaaatgaaagtctttttctttaggacccacatccataaatggaagaaatcctggctgcaataatgtctagagagtttttaactattttcttgtattctgaggggaattaagcttattcttacctagttgaattcctgccatccacactatgagcattttgaaattgaacttatattttctgggtgaaaataagtcatgaaggtcattcccttatgtaagctcaatgcctgcctgggcacaggggaaaagccacttagttaagtggcctctggtcattcttgtggtgtccactttctttctatgggattgagtaggtggcaggtgttttcaggggaaaccatcctacttgtttccccgaactctttgttgctctgaggacacagctttgctcagaaatgcagcgcagatccttacggctgatgctactctgctctgttctggggaaagcacaatataaagaaagaatttcccagccaggcgcagtggctcacgcctgtaatcccagcactttaggaggccgaggcaggcggatcacttgaggtcaggagtttgagagcagcctggctaacatggtgaaaccctgtttctactaaaaatacaaaaaattaccgggtgtggtggcgcacgcctgtaatcccagctactcgggaggctgcggcaggagaatcgcttgaaccgggaggcagaggttgcagtgagccgagattgtgccattgcactccagcctgggcaacaagagcgaaactccgtctcaaaaaaaaaaagaatttccctcagcaggagatcattttcagctcacgtgtcttgtcattcttttagtgacaatcttacaagaaaactataatgagagaggcattatgtacaaatatgtaagtagtttatttttaataactgcaaaaaaatcctatgtaacaactaccaaaagaaatcctatgaaagagtcctaacaggcattattaccatatcttatgtgattggcatgatagcacctctgataaatcattcagaggtttgccatgccccagcttcttttctcatcataataattgtagttgatactttgcctccaagtccgaggtgctatatagcttttgctaatggtatatttggtgttttgtatagttttgggtagagttgcagaacggagtttatttctatccggtagtcacaaattccttggctctatgaattttccatgaaaggaggaagtaggcttttctcgttgtgggtggtcttttttttttttggagacggagtctcactcagctgcccaggctggagtgtagtggcaccatctccgctcactgcaaccaccatctcctgggttcaagcaattcttccatctcaacctcccgagtagctgggattataggcacctgccatcatgcccagctaatttttgtattttagtaaagacgggggttttcaccatgttggccaggctggtcttgaactcctgacttcaggtgatccgcttgccttggcctcctaaagtgctaggattacaggcctgagccaccgcgcccggccccttatgggttcttctacactgctgggatctctgttttaagtgctcagcttcatgattgattgctgggcttccattttcccatccagttctggagttcgtagagagtgaagatggtagacttgaacagataaataaacttaacgatcttgtaagagttgtctagctacttaaaaccctcagaagtaagagcttagtctcacgagttgtaagagtgggatttggagcttggtggtggagactgacttcagctgagagatgcacaacagtcatggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttccaaaccagtttgagtcatacaaatgttttctaaacttttattgtattactgcaataaatcttttaacagtaaaaaaaaaaaaaaaaaa

SEQ ID NO: 6 - DNA, 1167 bp, Homo sapiens
tgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattgaaaaaaaa

SEQ ID NO: 7 - DNA, 8270 bp, Homo sapiens
aagagctcgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattacttaaaa

SEQ ID NO: 8 - DNA, 4241 bp, Homo sapiens
actggctccgcgagcctggcccgggggagtcggctggagccggctgcgctttgataaggtcctggcaactcagtaacagcccgagagccgggaaataaaaataacccctcagagcgatggatttcggggccgcccggcggccgaggcgcccgccgaaggccctgctgtaaaagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccaggcgtaggccgctatagcccccgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgttttgtttttttttttcctatgctgctctgttttgtcttaaaggtcttgagggttgaccatgttgcgtcatcatcaacattttgggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgttttacattagtcattggaccacagccattcaggaactaccccctgccccacaaagaaatgaacagttgtagggagacccagcagcacctttcctccacacaccttcattttgatgttcgggtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttcaaaaaaaaaaa

SEQ ID NO: 9 - DNA, 6492 bp, Homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 10 - DNA, 5106 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagttaaaaaaa

SEQ ID NO: 11 - DNA, 3575 bp, Homo sapiens
accatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaaa

SEQ ID NO: 12 - DNA, 2655 bp, Homo sapiens
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctaaaaaaaaaaaaaaaaaaaaaaaaa

SEQ ID NO: 13 - DNA, 4049 bp, Homo sapiens
agcgcgtaccactctggcgctcccgaggcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctaggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacacccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggcaaaaaaaaaaaaaaaaaa

SEQ ID NO: 14 - DNA, 1535 bp, Homo sapiens
cctccgctcagtccgggagcgcacgtgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagggcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctt

SEQ ID NO: 15 - DNA, 4704 bp, Homo sapiens
acttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttcaaaaaaaaaaaaaaaaaaaaaaaaaa

SEQ ID NO: 16 - DNA, 2060 bp, Homo sapiens
atttttggccctcgtgacagtgattgatagctgctgggaaggtataaaagcagcttgcctgcgaaggttcttcacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggtcagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaa

SEQ ID NO: 17 - DNA, 4209 bp, Homo sapiens
cttctggatgtgagacaggcggatctcacccacgcctgccagcagctcctcggagaactgtgttcctgggtcagccctggcccagaggagcgccggggacccgcagagtgctgctgaagtcaaggctacaactcacctaggatctggggcgccagccctccggtgggcagggcgttctcctcccccaccccctccccgcacgatgacatcaagtgtttggcgttgagttgctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatca

SEQ ID NO: 18 - DNA, 2300 bp, Homo sapiens
actcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaaca

SEQ ID NO: 19 - DNA, 2723 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtcaaaaaaaaaaa

SEQ ID NO: 20 - DNA, 3976 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacata

SEQ ID NO: 21 - DNA, 4304 bp, Homo sapiens
cacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccaaaaaaaaaaaaaaaa

SEQ ID NO: 22 - DNA, 6531 bp, Homo sapiens
gcccagccagcttgcgtcaccgcttcagagcggagaagagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaattaaaaaaaaaa

SEQ ID NO: 23 - DNA, 5489 bp, Homo sapiens
gaaactcttaacaaaaacaaggggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaattctccttgtttgggatcacatcttaatttttaatctgttaaaagttcttgatgtattttaatgagaagactttaggtgaggctacagtgattccagagtgagccttctaactggctagcagaagttctctaggtttggcatctgtgccttggagatactgaaagagaatctgtcatttgacaattgacctctttgtgggatggactcattaagtatgctctcagagactggtatattaccagaatgcctattaattttcagtgagaggcaacaggtattaagtagaacagaatgctcaggttggcagattagaacgatctttcaggagacaaagcaagttttaatcagttgtttggttaataagtatggggtgttcgctgtgatagggccccgccagcttctggctcttgtggacctcaaaagtatcaggtggttttgcaagtggtggtcctttcccctgccccaccccaataggttccccatctgtctagtttgatttttgtagacctttgttttctctagttagaaaatcaggtacactgaatatggttttcatgtaacacctcttctctggagataggggtatgttttcctacccttctagtggagaatcctacttgaggatgacctttcctctcttactaaataatattagtaaatagtgggcaatatattctgctttcagattttgatttgttgagatgtaaaagttgtttggggcttaccaaatctcaagactctctttagctcctgcaggattgtattgcttttcttactggatatttttcctgggtaagcatctttgtggcttcatctcttccccctgtggttttcagtgtatttagtcgagacctctctgctgagcttgcaacctgtttattcacatggcctgccatgccacttggaggtttctgattactcccaaacctgctggttctttatgtctttctcagcgaataattccatctattcatgttggaaacttaggtgatatgctcatctccttttgcctgtttatggaggtcaccagcctctatcatttgtatgatttcgtttacactgtttatatctctctgtcccccctttttctgccattggcatggtttagacctgtactctttatcagcagaggtactgtaatatatttgtgatccctcagcttccaggcttactcctggtctctgccttcctatctacatatccttttaaaataaaattttaactatctcctgaaaaattgttgagtaggtcacgcacaatcaggagaaaaatctattcatgacatacaagtctctgtctaatctgaacactgcacctgtctctggcctttttttcttgtcatttcctagaccttaaaaaatgtgtattgagaaagaactctgttagctatacagaagatgaactgggcaatatagagtagcagcatggagaccagtctgactgaactaaggcagtggaagtgtggatgaggaagagaggtgaaaattgagaagcgctatcctttctctttgggcattattaggaggctcacagacaagtccaggagcctggttataccctcctgtgccattcaaccaggtggctttcccatgactgtgatgaataaaattgagaagcccctgcccttttcagagcagagggtgaggagaaagctaccattttgtcctcatccttacccccgttgacttggcgagagatttgacctttcaggttttgatcctgtcattttctaggatgtggtgcacgcactttgctgttgcgcatggtgaagtattgtgcctaggtcctgggtcttcatctgtttggctctgctactgtttcctcctcccaggaagtgtggttagacaaataatgtgttttaattacctgtcacactcaggattaatacatactcaggttaactgtagagaggcattggcttcagaacactcctcgtgacaattttaaccattttctttgtctagagtctgcctttttcttttttacaatttcttttatttcaacactaggtttcaatatggtgttcctgctacctcccacctccctcctccctcatcacacatgcaaattgtcagcttattgagacaacccacttagattcatatatggacaaggacaaggtattttgcatttgttactggaattcagttttcctaactatttactaccagaaatggtcaataacttactttgtgtttagcaaatcaaattgtgtgatagatagtttcccagtatgatggccagtcagtctttccatccctgtgcctacatgctgctcttcccgtccacaagtggagtctgtttctcttgagttttggctggccttatgaatggctttgcttactgaagtgcagcagaagaaatttagtatatgtccaagcctaggctttaagagactggcagctttccttttatcctttttggaagctagccaccatgctgcaaagaagctcagctggattactgaaagatgagaggccatgtggagagagactcttgaggatgagagattatcttggatgttccagccttaagctcccagctgaatgtgggtgtatcctcagctacaccacagaaaacagaggaactactcagtcgatcccaatcaacccacagactcactagaaataacaaattattgttttaagccacgaggttttgggggagggttgttaaacagtaatagataagtgagacagattgcttgttatttatggtcaaatggtgattatctctggtgagattacaggtgatgttttttttaagttatgcctatctgtagtttcctttttttcctaaaattgatttgaattattagtgtattaacagaataaagaatgaactttaaaacacaaaaaaaaaaaaaaaa

SEQ ID NO: 24 - DNA, 5748 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 25 - DNA, 3193 bp, Homo sapiens
agaccccagccagtcttttgtgtacgtgcaggaccatggtggctttagtttctaccccacccttcctaggaactctacttgtggcaaacgtatgttcaagcttacaagtcagcccaccccactctgataaatgcaagaaaagctgaaaagggaggagcaagatgggatgaaagcatctgggccaaagtgacctgaaaacctttagagaagaagctgctggctgagaaggaggtgtgtggctccggtgagaccaccagcttggaggactggtcatcagctgcacgttctgggtctgtcttgggtattcccatatggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgtta

SEQ ID NO: 26 - DNA, 2122 bp, Homo sapiens
ggtggctattttgtccttgggctgcctgttttcagctgctgcaaccacagggatttcttctgttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgtaaaaaaaaaaaaaaaaaa

SEQ ID NO: 27 - DNA, 2535 bp, Homo sapiens
ttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctattcattgagtcaaaaaaaaaaaaaaa

SEQ ID NO: 28 - DNA, 10540 bp, Homo sapiens
aggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagtgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactatgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtctttcagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcccggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccggagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggaggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgcctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgtgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctcccccgtcttctcccctcagcaattcctgcaaagggttaaaaatttaactggtttttactactgatgacttgatttaaaaaaaatacaaagatgctggatgctaacttggtactaaccatcagattgtacagtttggttgttgctgtaaatagggtagcgttttgttgttgttgttttttcatgccccatactactgaataaactagttctgtgcgggtacagca

SEQ ID NO: 29 - DNA, 10640 bp, Homo sapiens
atactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcacttaaaaaaaaaaaaaaaaaa

SEQ ID NO: 30 - DNA, 5910 bp, Homo sapiens
agctccagccgcactgccccgatggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactgaaaaaaaaaaaaaaaaa

SEQ ID NO: 31 - DNA, 1145 bp, Homo sapiens
cttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaaaaaaaaaaaaaaaaaaaaaaaaaaaaaaa

SEQ ID NO: 32 - DNA, 2141 bp, Homo sapiens
gcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgtaaaaaaaaaaaaaaaaaa

SEQ ID NO: 33 - DNA, 1730 bp, Homo sapiens
ggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataaaaaaaaaaaaaaaaaa

SEQ ID NO: 34 - DNA, 4372 bp, Homo sapiens
ggtgcctccgggggcggggcctccttcggttggcggcctcgggcttcgggagtcctccaagaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaagaaaggtaaaaaaaaaaaaaaaaa

SEQ ID NO: 35 - DNA, 479 bp, Homo sapiens
acacatctgctcctgctctctctcctccagcgaccctagccatgagaaccctcaccatcctcactgctgttctcctcgtggccctccaggccaaggctgagccactccaagctgaggatgatccactgcaggcaaaagcttatgaggctgatgcccaggagcagcgtggggcaaatgaccaggactttgccgtctcctttgcagaggatgcaagctcaagtcttagagctttgggctcaacaagggctttcacttgccattgcagaaggtcctgttattcaacagaatattcctatgggacctgcactgtcatgggtattaaccacagattctgctgcctctgagggatgagaacagagagaaatatattcataatttactttatgacctagaaggaaactgtcgtgtgtcctatacattgccatcaactttgtttcctcatctcaaataaagtcctttcagcaagttaaaaaaaaaaa

SEQ ID NO: 36 - DNA, 1815 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataatacctaaaaaaaaaaa

SEQ ID NO: 37 - DNA, 7110 bp, Homo sapiens
tgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatgttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctgttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgccta

SEQ ID NO: 38 - DNA, 6159 bp, Homo sapiens
cgcgggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtcaaaaaaagaaaaatgttgcatctttgtgattttaaaacataaattaatgaaggctctgataggctattaggagttggcttggaaacagtttttggtctcacaggttaccattgtttggggatgtctgagctgttttcagatctaggaatagcacagtgttgtcttgtctttggcagtctcatttggctctgtttcttgcaccaccagcgtgttcattaccacttaaatatattgctacagcagtggaacaacagagtggtgcaagacactgtagattaacggtagaggagaaattgtgcccttagtgttaacaatgtgccttttgttctgaatgccatgttgtagggcatgcattttttggcctctttaactcttcgaattctagtcagtaagaatggaacccatctctgcaaagatacatctgtcttaaatatctagttacaggccttaatagaaaccataaggcatgactcatcttcaggcactgaaaaaagataaccatcaggtagtgttacacaaggacttcctatatttaaggggttaaagatggtctttgttgtatcttaacatcagactgatttttacattttttttttgttatgctaacactagacaaaaatcaactgtatttgtaaaaatttacctcaaaccatttaattttatagtgtgattaatcccagggcatttggtatgaaccaaagtgcattccttttatatgtgcctggctctagtaaggatggccagggatttttacaatttgggtgcaaggcacttaagccacttttaaacttaatgggtggtttggggtcgtgttaaatgactccatcagaatgttagaaaacactttaggcatcagtagcattgggccatattggaatcctaaagtgtgaattattttaaggagagcattcatttttgtaatttttttcatcaaaaatatttctggtaagcagaagactttttaaaaaaactgatctggtctcggtaaaggttttaatattgcccaacataatgctgtaatagcattaaaaaaagtatttgtgaactctgtttcttaggggcttgtacatctctctgctatggacatacataaaattaattgtaattatactcagctcaactgctacagttctgtctaggcagtggcttgggtttttatcgagcaacaacttagacacgtgactgtaatatgctgcaactgtgtgtactgaaaatatgtgaaaatggttgaatgtggactgtgtatatatgtatgtaaaaatttctgtgagatgctgctgtcgccacttaacattaaatatgttctagtggattttaatcctagtggccagttctatgatactgtatgtattatacagctgatgacaggagtaagactgtttagtgaatatctgttaaattttattgttgtggccagagataatttcagaataaaattttaatgtcctacctta

SEQ ID NO: 39 - DNA, 2495 bp, Homo sapiens
ccaccagacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatctcagttcacctggtatccagctccagcaacttagagcgtttcacgtcacgccgggcgccaggcgtcggcttgtataacctgaaaacgctcctgtttttctcatctgtgcagtgggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataataatcttttatttatgatgttgattggctccaaaatagtcttaaggaaataaatactgggtctgtaggggaaaagtagacttcatagtttaaaatcccattaaccttttcaccgcagttgaaatgcatccagcctgattttcctatcattttggaatttttaaggatttttactttcttaagttactgcctagaatcaacattcggtgagattttgaaatgtcatagatactgtacaggccaaaccttactaatttattttacttaaagtgatattttatagaaaaatcataagttatacaatgagaaccctttaagcccttagcctaagctttcagactaaatgtgattatagaataagatgaaagttaactttggtacagagctttttatagccccaaattatatttccagttattatattcattagaatttctgctaataaactcccaacttaaatagaaaaaaaaaaaaaaaa

SEQ ID NO: 40 - DNA, 4866 bp, Homo sapiens
cattctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 41 - DNA, 4234 bp, Homo sapiens
cgtgagcggcgcagcaagatcccagctcggaccccggacggcgcgcgcccccgaagccccggatcccagtcgggcccgcagctgaccgccagattactgtgcatcccgaatcacgaccacctgcaccctcctgccccggcccgccccccaagtcctcaggcacccagctccccggcgccccggatcctcctggaccggtccgtccagattcccgcgggaccgacctgtccgcatccccaggaccgccgggctcggtgcaccgcctcggtcccggagccgcccgcctggattgcattccctcctctcctggatctcctgggacccgacgcgagcctgccccggagcccgccgagcgcaccctctctcgggtgcctgcagccccgccggcgcggcccggcccggcgcggcccggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgaaaaaaaaaaaaaaa

SEQ ID NO: 42 - DNA, 4664 bp, Homo sapiens
gcttgctcccaatcacaggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagctaaaaaaaaaaaaaaaaaa

SEQ ID NO: 43 - DNA, 5765 bp, Homo sapiens
actccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagcaaaaaaaa

SEQ ID NO: 44 - DNA, 4628 bp, Homo sapiens
tcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtttccatcttctacaggcagtcctcagtacaactgtgattccatcatgtatcccaggagagtccagtgataactgcacagctttagttcagacagaagacaatccacgtgtggctcaagtgtcaataacaaagtgtagctctgacatgaatggctattgtttgcatggacagtgcatctatctggtggacatgagtcaaaactactgcaggtgtgaagtgggttatactggtgtccgatgtgaacacttctttttaaccgtccaccaacctttaagcaaagaatatgtggctttgaccgtgattcttattattttgtttcttatcacagtcgtcggttccacatattatttctgcagatggtacagaaatcgaaaaagtaaagaaccaaagaaggaatatgagagagttacctcaggggatccagagttgccgcaagtctgaatggcgccatcaaacttatgggcagggataacagtgtgcctggttaatattaatattcccattttattaataatatttatgttgggtcaagtgttaggtcaataacactgtattttaatgtacttgaaaaatgtttttatttttgttttatttttgacagactatttgctaatgtataatgtgcagaaaatatttaatatcaaaagaaaattgatatttttatacaagtaatttcctgagctaaatgcttcattgaaagcttcaaagtttatatgcctggtgcacagtgcttagaagtaagcaattcccaggtcatagctcaagaattgttagcaaatgacagatttctgtaagcctatatatatagtcaaatcgatttagtaagtatgttttttatgttcctcaaatcagtgataattggtttgactgtaccatggtttgatatgtagttggcaccatggtatcatatattaaaacaataatgcaattagaatttgggagaagcaaatataggtcctgtgttaaacactacacatttgaaacaagctaaccctggggagtctatggtctcttcactcaggtctcagctataattctgttatatgaggggcagtggacagttccctatgccaactcacgactcctacaggtactagtcactcatctaccagattctgcctatgtaaaatgaattgaaaaacaattttctgtaatcttttatttaagtagtgggcatttcatagcttcacaatgttccttttttgtatattacaacatttatgtgaggtaattattgctcaacagacaattagaaaaaagtccacacttgaagcctaaatttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggaggctccttcatcgaatgctaaacctttgagtagagtctccctggatcacataccaggtcagggaggatctgttcttcctctacgtttatcctggcatgtgctagggtaaacgaaggcataataagccatggctgacctctggagcaccaggtgccaggacttgtctccatgtgtatccatgcattatataccctggtgcaatcacacgactgtcatctaaagtcctggccctggcccttactattaggaaaataaacagacaaaaacaagtaaatatatatggtcatatacatattgtatatatattcatatacaaacatgtatgtatacatgaccttaatggatcatagaattgcagtcatttggtgctctgctaaccatttatataaaacttaaaaacaagagaaaagaaaaatcaattagatctaaacagttatttctgtttcctatttaatacagctgaagtcaaaatatgtaagaacacattttaaatactctacttacagttggccctctgtggttagttccacatctgtggattcaaccaaccaaggacggaaaatgcttaaaaaataatacaacaacaacaaaaaatacattataacaactatttacttttttttttttctttttgagatggagtctcgctctgttgcccaggttggagtgcagtggcacgatctcggctcactgcaacctcacctcccgggttcaagagatcctcctgcctcagcctcctgagcagctgggactacaggcgcatgccaccatgcccagctaatttttgtatttttagtagaggcggggtttcaccatgttggccaggatggtctcaatctcctaaccttgagatccaccctccacagcctcccaaactgctgggattacaggtgtgagccaccgcacgtagcatttacattaggtattacaagtaatgtaaagatgatttaagtatacaggaggatgtgaataggttatatgcaagcactatgcccttttatataagtgacttgaacatctgtgcccgattttagtatgtgcaggggggcgatctgggaatcagtcccctgtggataccaaggtacaactgtatttattaacgcttactagatgtgaggagagtctgaatattttcagtgatcttggctgtttcaaaaaaatctattgacttttcaataaatcagctgcaatccatttatttcatttacaaaagatttattgtaagcatctcaatcttggtttgtcagtttatcttaagcatgtcaattcataaaaacaagtcatttttgtatttttcatctttaagaatgcttaaaaaagctaatccctaaaatagttagatctttgtaaatgcatattaaataataaagtatgacccacattactttttatgggtgaaaataagacaaaaataatagttttagtgaggatggtgctgagtaaacataaaaactgatttgctctcagctgatgtgtcctgtacacagtgggaagattttagttcacacttagtctaactcccccattttacagatttctcactatatatatttctagaaggggctatgcatattcaatgtattgagaaccaaagcaaccacaaatgcataaatgcataatttatggtcttcaaccaaggccacataataacccagttaacttactctttaaccaggaatattaagttctataactagtactcaaggtttaaccttaaaattaagatttccttaaccttaaccttaaaattgatattatattaaacatacataatacaatgtaactccactgttctcctgaatattttttgctctaatctctctgccgaaagtcaaagtgatgggagaattggtatactggtatgactacgtcttaagtcagatttttatttatgagtctttgagactaaattcaatcaccaccaggtatcaaatcaacttttatgcagcaaatatatgattctagtgtctgacttttgttaaattcagtaatgcagtttttaaaaacctgtatctgacccactttgtaatttttgctccaatatccattctgtagacttttgaaaaaaaagtttttaatttgatgcccaatatattctgaccgttaaaaaattcttgttcatatgggagaagggggagtaatgacttgtacaaacagtatttctggtgtatattttaatgtttttaaaaagagtaatttcatttaaatatctgttattcaaatttgatgatgttaaatgtaatataatgtattttctttttattttgcactctgtaattgcactttttaagtttgaagagccattttggtaaacggtttttattaaagatgctatggaacataaagttgtattgcatgcaatttgaagtaacttatttgactatgaatgttatcggattactgaattgtatcaatttgtttgtgttcaatatcagctttgataattgtgtaccttaagatattgaaggagaaaatagataatttacaagatattattaatttttatttatttttcttgggaattgaaaaaaattgaaataaataaaaatgcattgaacatcttgcattcaaaatcttcactgac

SEQ ID NO: 45 - DNA, 6330 bp, Homo sapiens
aggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 46 - DNA, 3376 bp, Homo sapiens
ggcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaaaaaaaaaaaaaaa

SEQ ID NO: 47 - DNA, 1909 bp, Homo sapiens
gaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaaaaaaaaaaaaaaaaaaaaaaaaaaaaaaaaaaaaaaaaaaaaaaaaaaa

SEQ ID NO: 48 - DNA, 14773 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttgagctttaaaaaaaaaa

SEQ ID NO: 49 - DNA, 6800 bp, Homo sapiens
gctgcggccggctgcggggataaatactgcggcagctactgccgcgcagcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggattgcttgagcccaggagtctgaggtttgcagtgagctatgattgtgccactgcactccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctgagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggaatagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgagctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaacacaaaaaaaa

SEQ ID NO: 50 - DNA, 4654 bp, Homo sapiens
ggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaataaaaaaaaaaaaaaa

SEQ ID NO: 51 - DNA, 2428 bp, Homo sapiens
cccgcccacttccaactaccgcctccggcctgcccagggagagagagggagtggagcccagggagagggagcgcgagagagggagggaggaggggacggtgctttggctgacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacataaaaaa

SEQ ID NO: 52 - DNA, 2579 bp, Homo sapiens
gcagagcagcggcggcagcggcggcggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttaaaaaaaaaaaaaaaaaa

SEQ ID NO: 53 - DNA, 3207 bp, Homo sapiens
gctaagtcaacatataacagcaaacttacaacaattatttaacatttttaaagccatgaagaagggacagagcacggagcggccggggagagcggcagagccagaggcagaggcacggctggctccccgggagggcccttgcggcgcggggcgcagtgcctaggccgcccgggtctcctgcgttgcggggagcgcagcgcaggctctcgcttgccatgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaaagcaaacaatggcacggttcttctcccggcccagcctgagcctccgctgagcgaaaggccacagctcccaccggcggaggattttaaaatgatctttgcctgggtcggcctgtgggttcagggaagtgttaccaaccattgcgcgcaggtgggcgcgctcgcctgccttctccgaagcaaacttttcccagcaactgggagcagctacggagacttaaaagatccccgcggggtcgtgggcaccgcacgtgggccctgcagggacctccaccgcgggagattccttgacgtttgacctgtctaatggagtgtggtcttcagccgcccaccgcaggtcctgcgagtcccgggcatgcaagggcccgcagaccacccaaggcaggccttacaggtgcagttgaggtcctttcgaccggggacccccgtatgaccgtcgcctgcttcgctgttgccgtgtggctcaggccttggttttgagcccatctgggtggtgggtggtcacagctgggtttgttcctgacttgaagttgtggaggtgccgggggtgaccccgggttttcaggttttctgagagatgtagggcccgatgaggatttatgaccaatgttcagctatagaagctgataaccacccagagcaataacacttttattttaaacagagactttttctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtgtgaggggaaggggatatgccttggacaatgtcagagttttgatttccatgttttttcaagatccaggcttggtggtcgctatatttttcagaaacagataatgaaagactacatttaatttaaaaagttgggtgaaacaaccaaaagcagatgcagagagagagagggatgaatgcgggggaagaataaggggacgtgctggtgtccgctggaaggggcctctctgggccccagaggacctgaggtttgatggcaggaatctcccagacactcctggcccccgcaccccctgcagccgcccgctcttccctcccagccctgccaggcaggcctggaggctgatactaaatcaaaaccttaaagaggtgactggcagtctggggaggggagaagaggtctgcaacgaaaatctaattaagaacattgagatgttcacaaccaagttcagcttgcagcttccggggaaatgcaaccgacctctatgccatctctagctgggtaatcttcgaggccctgaaatgcaattttctgaacctctaagtcacttttattttatgtcatgtgataaagacacaagtagtcacgcactattggaaataggttgggagggaggtctttaagatcgcttttaaaatagtttccaggacttgtctaaaaatgatgacaaactttgaatccagagggcctgttggtcaatgtgttggaaaggacatttcaggccggcagagtaattggataattcacaggcatagaggtgacttttggaaaattcattctcctatccatgctgaaccaggcttccacgactgggttctacccaggccagtgggaagactctgggaaacttcaggccagccttgattggaagaacttccaggaggagccattgctgagatccaggctcactgtgattcactgaaaatgtagcgaaagggctgtcactggatattttgctatcccaaactctcagcctctgtgaataaagttgttttttcattaacctctcaaaaaaaaaaaaaaaaaa

SEQ ID NO: 54 - DNA, 3551 bp, Homo sapiens
tttcaaacagcggaacaaactgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatgaaaaaaaaaaaaaaaaaaa

SEQ ID NO: 55 - DNA, 1834 bp, Homo sapiens
ttgggaagggtttccagaaggtgggaaatgtcacctgattcacactgaacttttgaaagctccccacccccaaggagccgcgcacaccctcgctcgcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcac

SEQ ID NO: 56 - DNA, 3628 bp, Homo sapiens
agagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaa

SEQ ID NO: 57 - DNA, 3851 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatac

SEQ ID NO: 58 - DNA, 1398 bp, Homo sapiens
ggagagcggggccctttgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatttcaaaaaaaaaaaaaaaaaa

SEQ ID NO: 59 - DNA, 3618 bp, Homo sapiens
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatcagaaaaaaaaaaaaaaaaaa

SEQ ID NO: 60 - DNA, 8228 bp, Homo sapiens
ccgcgggtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccactgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaaaaaaaaaactgtaagccccgccccctttttagtaaaccgatgtaaatttgtgatgtgcatattcttctttcttttagaagagcagtcaaattaaaggatttgacatgttttgctgttgctcaaaggaaataggagttggtgtgcttgtgaccaaggggttacacttccagcttttaaaattctcctttacatgtgctcagtgttttgttttgtgttttggtttctgttttttattttaattcccacattgggcacaagaatcagaatatggatagctagtttaagaaacttttgtgggtgcactgtagcatagatgacagaatattgatgttccccccatctccaattcagttcagggcattccacagttaaacagaaatgggaacgtggggctcttataaatgaaatgggcgctcacagttttggttttcagctcttcatgtctgtaagtgtgctttgggggaggctatgtctgtatggtcgattctcagttatcacatttgcctctcctcccactaccttcatgaacattcagtgctgtttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgatacacataaaagtcatactgtgtgtgcacaaagagtacatggattttccagcatattgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttctttttttttttatatttgctttcctttctactgcttttagatttgcaggagatgcaagtttcagctcaatgtttggcttctctcaatatggaaatttcagaaggacagaggagaggagggaggaagaagaaagtatactcctccagaatttcagtgatctgttgtggcagtccagtggaaggaaggtcttttgaggtcacttagaagcatctttttgggacatccttttgggatctctgtaggctaggcatctcatatcttgagactcacccccagcctccaagcctctctccatttctctaacctatgcattttagagcgagaggaccgcctcactagtgtcaccatcctgccttttctaaaacatgcaggctcacacattctactcctgcttaatgtctgtgttaaacgttttctaaccatttttgttttatttttctgaaaaagttaacccctcccaactcctcacacattggctcttcctcttgagccacaaagttttgattcttgcgatgtatgtgccttattttatgttaatcttgtcaatgagagggaccagttggtgttgcccaatcagcactccaaggctgtgtgtgcaccagccagagagcgcacggtggtagcagagtcgaggctgtcttgtatcctggtttcatgtgttgttttgaactgataggaggatgttctcttctgacaagttacccttgtgtatcctgcagacatgtaaaataaaatacaagttcatttttttcaccttttttagatttttttaaaaaataaaatgtgtaatcctttttttaaaagaaacacatgtaaatacatttaagtattgtaggcatagcgttcagatgtgactggcccaggcgttcctcggacaagcctgcattccccgtgatcacgcccacctcaagcccaggggctgcagcccagccacagatgaactctacctttgctttcagaaccacttagtccttttgtaacaaagaaaaaaaaatgtttcttacaatgtcaataaaaaattctttgtatggaaaaaaaaaaaaaaaa

SEQ ID NO: 61 - DNA, 4737 bp, Homo sapiens
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctgaaaaaaaaaaaaaaaaaa

SEQ ID NO: 62 - DNA, 8482 bp, Homo sapiens
aaataaagttttttcaatggaaggcttgcagctcttgaggacctgccaaatggaagaaggacagagacctggagccctatggaaagttctgacaccatgtgtggaaggacatggcttttaacacgtgtggtgactggagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 63 - DNA, 2322 bp, Homo sapiens
gggagggggtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctggggggttatgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaaaaaaaaaaaaaaaa

SEQ ID NO: 64 - DNA, 3555 bp, Homo sapiens
ggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattttttaaaatatatacttccttatgcaaagtaatttacacagaaattccattgtaaattgataatggattttttatgttactagaagagattatttgacttcccaggaattttctgtctgtaatcactaaagtcaactttaatagagttttgaaacagtactgtgcaatccgatggatctaattaaaaaaaaggcaatatttttatattaaagtactatactaggagagaatgtttcagaactccctgatgaatttctaagtgagcaacttgatataaaattgtaatcttcatttttgtcagtgtatccagttacagaatgctacacacttacctttttattggctgagaaatctggttatttcatcttaatctcaagattgttttcaagtgttttataattaaatcataatagcatattttaaaatcaatcttcctaaaaggtctgcttttattgtatattttatttaacaataggcactgggtttgtgttacatatttatatattttattttatttttataatatagacatcacctag

SEQ ID NO: 65 - DNA, 3241 bp, Homo sapiens
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccggcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaaaa

SEQ ID NO: 66 - DNA, 914 bp, Homo sapiens
gcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgtcaaaaaaaaaaaaaaaaaa

SEQ ID NO: 67 - DNA, 12262 bp, Homo sapiens
agtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgcaaaaaaaaaaaaaaaaaaaaaaaaaaaa

SEQ ID NO: 68 - DNA, 1660 bp, Homo sapiens
ggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttaaaaaaaaaaa

SEQ ID NO: 69 - DNA, 2638 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaaggggaaaataaaaaaaa

SEQ ID NO: 70 - DNA, 2246 bp, Homo sapiens
aaagtccgggggagccggtcccgggcagccgctcagccccctgcccctcgccgcccgccgcctgcctgggccgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccagatgaaaaaaaaaaa

SEQ ID NO: 71 - DNA, 980 bp, Homo sapiens
gcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcgctgaaaaaaaaaaaaaa

SEQ ID NO: 72 - DNA, 1484 bp, Homo sapiens
cccgtgaggaggaaaaggtgtgtccgctgccacccagtgtgagcgggtgacaccacccggttaggaaatcccagctcccaagagggtataaatccctgctttactgctgagctcctgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaaaaaaaaaaaaaaaaaaaaaaaaaaa

SEQ ID NO: 73 - DNA, 1718 bp, Homo sapiens
gagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 74 - DNA, 9059 bp, Homo sapiens
gagaaggacgcgcggcccccagcgcctcttgggtggccgcctcggagcatgacccccgcgggccagcgccgcgcgctctgatccgaggagaccccgcgctcccgcagccatggccaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 75 - DNA, 5845 bp, Homo sapiens
ctcatgcatatgcaggtgcgcgggtgacgaatgggcgagcgagctgtcagtctcgttccgaacttgttggctgcggtgccgggagcgcgggcgcgcagagccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccgcggcgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacgagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgctgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccattgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccaccattccggcctcccttgttctttcggtgctgtcccttttgtattgagagtgaggttgggggagagccacgccggcagagaggcttggggcagtggggcgcgtgctgggtattggcccacgtggctgtggtggctgtagagggcgagacggttctgttgagtcggggcctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaattaacaggtcaaaatttttattcattcatttattcctttgttttgcttggtcattcagaggcaaggtcagcatttgatggaggcaggagagaagcagcccttccacctggccctggagctggttttgcccctcactgcttgagccaactggaacgtggcatggtggcctcagggctgggcatggaaggccgactccaaggctgactccgagccgcctgtcagtgatgtgcaagtctttaccctgctgtgaggggtaggaggtcaactgagtcaaggagcaaagccaagaaccagatctgtacaaaagagaaaaaaaaagtcctgctgacagcctgggagtgaggctgccttgcacaggcagaacaaatgaataaatgaatgaacgaataaaaattttgacctggtaaaaaaaaaaaa

SEQ ID NO: 76 - DNA, 3508 bp, Homo sapiens
tgagttgctgccttggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcg

SEQ ID NO: 77 - DNA, 7128 bp, Homo sapiens
aaaagcggcctctcggctgagggccggggagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgaaaaaaaaaaaaaaaaa

SEQ ID NO: 78 - DNA, 1655 bp, Homo sapiens
gcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaa

SEQ ID NO: 79 - DNA, 2949 bp, Homo sapiens
agtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaaaaaaaaaaaa

SEQ ID NO: 80 - DNA, 4679 bp, Homo sapiens
gagccaggcgggggcggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttcttttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcatcttgagtctggttgttttttttgggggaagggggttgttggaacagattcctcctgcattcatcaccctggcttcctcctgggggcaaatcttcattgagcaaccctgagaacaactcaccgacctcagccccttcctctttccacagcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgccaaaaaaaaaaaaaaaaaa

SEQ ID NO: 81 - DNA, 1490 bp, Homo sapiens
agatatccgcccctgacaccattcctcccttcccccctccaccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaagggaaaaaaaaaaaaaaaaaaaa

SEQ ID NO: 82 - DNA, 1077 bp, Homo sapiens
aaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacatatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccaaagatctaagataaataaacaagagaactt

SEQ ID NO: 83 - DNA, 3620 bp, Homo sapiens
agcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcatttaaaaaaaaaaaaaaaaaa

SEQ ID NO: 84 - DNA, 2073 bp, Homo sapiens
agatgccacgccccatagctccaccagtcaccgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaataaaaaaaaaaaaaaaaa

SEQ ID NO: 85 - DNA, 4625 bp, Homo sapiens
aaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaaaaccaaaaaagaatctctcagttagtaagaaaaggctgaaaacctcttgatacttgagagtgaatataagtctaaatgctgctttgtataatttgttcagctaagggatagatcgatcacactatttaagtgagcccagatcaaaaaagcagattgaaattttctttagaaaagattctccatgatttgaattgcattctctttaaactcaccaatgtaatcattttgggaggagggagaacccacttgctttccaaatgggtttatttaaacccacaaactcaagaggttgttgggggaattaggaaaataagggttttcaatgacctacattgctaggtagaggctgtgatccatgggatttcattctaatgaccatgtgaagatgtttgagtcctcctttgcctttcctcagaaagaatccttctaaggcacaaatcccttagatggataatgtaaggtattgttaactcactcatattgagatcatttttagagataccaggttttatgtatcagcactagatggttccaccctcatgggataaaactgcttacaagtattttgaaagaaaaactgaccaaaattcttaaattgttactaaggcaatcatgcacaggtgacgtatgtcttatctgatttgtttttaactccttggtgcccaaagctcagaagggaattccactgccagcaatgaacatacctggaaaagaaagtaagcaatctgggattttttttctgggttagtaaagaatttttgcaataagttttatcagttgattcaaactgatgtgcatcttaatgatcaaatgtgcacattacataaattaagtccactgatacaacttcttacacatgtatctctagtagctctggcaaacccaatatctgacaccactttggactcaagagactcagtaacgtattatcctgtttatttagcttggttttagctgtgttctctctggataacccacttgatgttaggaacattacttctctgcttattccatattaatactgtgttaggtattttaagaagcaagttattaaataagaaaagtcaaagtattaattcttaccttctattatcctatattagcttcaatacatccaaaccaaatggctgttaggtagatttatttttatataagcatgtttattttgatcagatgttttaacttggatttgaaaaaatacatttatgagatgttttataagatgtgtaaatatagaactgtatttattactatagtaaaggttcagtaacattaaggaccatgataatgataataaaccttgtacagtggcatattctttgatttatattgtgtttctctgcccattttctttaaattcattaactgtatatatgtaaatatatagtacttgtaaatagattccaaatttgcttttctattgggtaaaaaataaatttgtaataaaatgtgtgactatgaaacaaaaaaaaaaaaaaaaaa

SEQ ID NO: 86 - DNA, 561 bp, Homo sapiens
accacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 87 - DNA, 3470 bp, Homo sapiens
atacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaa

SEQ ID NO: 88 - DNA, 2379 bp, Homo sapiens
gacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaaaaaaaaaaaaaaa

SEQ ID NO: 89 - DNA, 2736 bp, Homo sapiens
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgaaaaaaaaa

SEQ ID NO: 90 - DNA, 7852 bp, Homo sapiens
ggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaaaaaaaaaaaaaaaaa

SEQ ID NO: 91 - DNA, 1823 bp, Homo sapiens
gagaagctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataaaaaaaaaaaaaaaaaa

SEQ ID NO: 92 - DNA, 2151 bp, Homo sapiens
ggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccaggggacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgaaaaaaaaaaaaaaaaaaaaaa

SEQ ID NO: 93 - DNA, 8716 bp, Homo sapiens
gccaatgggcgcgcggggaggcgcgggccgcggcggcgggctgggggctcggcgctcccgggcgtcagtcgggccgcggcgacggcggcaggagcgcgtcccggcgccgcctcgggctccgctcggctcgggggctgcttcgggaggaggagagccaagggaggcgccaggcccgcgggccgggcgcatggcttagggacgctcccggccgccgcagccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccttctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaacctgaaaaagaaccagtcagctagccagggtctcagagaaaagcagattacacactcaaattgggtaatttgagcagagcttaataaaggcagtatttacaaagtgtgggctaagcctcccatgagagtgcagaaccctggggctagcagtgtggggcgctattcccacccctgggcctgagtggggaaggagttatctttagcagacagaggattgctggaggagtgagaggggcacctgaaggagctgtgacctttgcttaaaggatgcagccagtcatggggaccctccagggaaattaatatcctgacctgctttcctgccccccagccccctcaatccattggctgaggccgctggaagccaccgggccaagggagcttgttgatgtgggtcacacgggcatgttcccaggtcagagaggagagtggagagtgaatctagggagactcaagagggagaagtgactccagctaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcccatatgcattttgttaatttttaaagtatttcaaacacaaagtttgaaacagaaaattgtgtaacattaactatgaacttaccacccagaatttacaaatgctgacattttgcaatatttatttcggatctatttttaagggggggaaccctgcagttactgcttaatcctcttcccaccccacccttttatttttacacaaggagcatagtgttcatacttatgctatttttttcagtaactgaatatatttggagatctccctccctaggtcatagagctctgcccccttctctctaacagctgctcagccttctgtgactagaggtgctgtcaccagcttgccccatcccctcctggtggtcataagggtcatctctcatcccaggctctggcgaacactgtgctgagagtccttgcatacagctctcccggtgcccacaggcaggaacacaggcgacagaaagtttccacgtggaactgcagagttcaagagcaagtgtgatttcaattttgatgagattgtacatgacctctaaaagaggttatactggccgggcacggtggctcacgcctgtaatctcaacactttgggagaccgaggtgggtggatcacctgaggtcaggagttcgagaccaacctgggcaacatggtgaaaccccgtttctactaaaaatacaaaaaattagctgggcatggtggtgcgtgcctgtaatctcagctactcgggaggccaaggcacgagaatcgcttgaacctgggaggcagagattgcagtgagctaagattgcaccactgtactccagcctgggcgacagagtgagactccatctcaaataaataaagaggttatactgaataatgaggaatcaaaggaagaagaagaaagagagaggaaggaaggttggaaggaaggaaggagggaaaattagaaggggaaaccatgattgctggtgaggttttgagcacattttcctgcaggctggtatgggtgagaggtttggtcttgtttgcaaatcttctgaaggccattccagaggagcagttgccactgccccatcccctgagctctgagcgtgggggttcccctggggagactcctggtgagaggatgccgatttctgctgatctgtcactgggtaccgaggactgggtgtgtttaaggcagacagccaggtgaggatcccagctactggggcctgctgtcatctcctgggagtacccgggggtcaggagcctaggggactcttgcacttcacatccagccatgctaattacactttttggcaaaggaaacagctaggagcagtttctttcactcctacagccccgttttctcagtgtttagacctcgaattattactgggctagagggaaggcagcctctgaagtgtggcaggaggaggggaagtctgcctgcatcttggtgtgtctgtcagatgccagcactaataacctggcttctgtgaggcctgtcagtgctctcaggaatgaaaggggacccctgagaggtgctcagtaccagcaggctgtgaatgctctctacccaccaccctcacctcctcgttaaagatggtgctacctgccacacagcagacatctggtcgctgcacacccgaaagaccccaaggcagtctgccccttgtccagccacacgccagcacccaccctcctggcccctgcctcggcctccccagaccagctgcacccagcccccaacacgcaccccttctccagatgtgtgcagggcctcattttgcagagcaaagacagatgtttcagccacacgctttattaacttctaaaacctgtgctcaggacactcttcaacagtcatgaaaagtttgatcacttgccacagtcaggacctttgtgtggggctctgatctgatgttcggtctcatcatctcccaaaccagcagtcgtttgtaccccaaccctctgctcaggggctcatacccccaaatgattttcctgatttatgtatttccctacaaagggctttctatacctagcatctgcctccagcatgagaagggggaataggtgagacccatttgccagtagcagacggggaccctggggagaaaatggcagagcctgttggagactccctgtctccagctgaccagccaatgggattcctcttccctccactgtctcccacaaagtagaagaatcctggtacatttagcccatgagcctggcacagatccctatctagacatgaggccctttagacatgactttggcattgaccagcctgttggcaatgggtcggggaggcagaggggatgctcacaccagtaattctcatcccctgaatgcttgggatcacctggggagagttcacaaaatactggtgcaggggtcccacctctgatgatgctgagtggtgggtctggggtgtggcccaggcatcatgatgtttcaggcccccaggtgacttcttaggcagcccagctaagcccctagagccttgcaatttcccccaaatgacctcagagggcccgatttgagggaaatgcctaacttcaggggccgtaagaatcccccagggagcatgtgaaatgcagataccaggcccacccccagagatgagctgaggtgggtcaggggtgaagtgcagggatcagtgtttttcacaagctccatacctccaggaaatggtgttgtggttgggcccgtagaaaacattctgagagtcctgttgcctgtgccttggtgcacgtggggtggaatcccagtggccctgccttgaggaggatgtgcattaacgtggtaggggagacagagacagctccacctgccccctgccccaccggggacctccaaaaacttcatggatgttagagcaagcagccatgctgcagcagaggatgaggctggcggatttagtaagagccctctgtgtttgggctgagttctttctctagttgccctgtcatctggcctctggataacccacctctcctccctcatcctaaaattacagatggcgaaagatggccacatttagtgagacccctaaggtcctccaactagggtgggtccacagtggcccctggtgcatggaccacacactctcttccctcctctggctcaggactacggtctgaaattagggagatatgaatgtctttcttgaaaacttctcttcccagtcttcccactttgcttgggggtccttggtcaaggccagctttggggactagggcttgttgcgactaccagctgtctcattttgctgtactgcaaactcaggcttggttccaagcttatgggggccctgtccttcccctagtagggtttgttttggggtcacatctggtcatacccttcagagagctcttccccagcctctacatcagggagagaggtaggtagggaggagcattcaaggattagaagaaggactaaagtacaacagccttggaggaactgccaggaactaagggcgagcactggagaaggcaacctgggaccccctgcgcttctgagcaggaagaccaagaccttcaggggccctaagcactgaaaacatcattcctcatccccaagccctggcatccccctgttcttctaaaataattcttttctaggtatttctgattgcaaaattctggatgggttcatccaagctgacctttgctgttttttcccttcccaacaaggcctcactttttggagccaccttagctggtgcctaggcagaggggcagtcagcagtggttatcaggatcctggctctatgggttgccttcctcctggtctgtaaagcccctgcaggcagggacttcttagatagctgcttccttagggcatggcatgtagtgggtggttaatgaatggaagagagggaatgagtgatcaagggagggaggagggagtggagtggagatttctcatcctttcctgttaatttatgacatcctcctgcctatgagtccttgactctggagttttacaaagcagtcacatttcaaataaaagtctgggaaagcaacacatcatcgccaacttttaattttgctaaataaggatattagaaaaagaatagaaaattgcagtcccttactgtttaaagaaaaaccaaaagaagttaaaaagaaaaaaaaaacaacctc

SEQ ID NO: 94 - DNA, 2095 bp, Homo sapiens
gcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaaaaaaaaaaaa

SEQ ID NO: 95 - DNA, 1857 bp, Homo sapiens
ccggacctcggctttcaaagcggcctgggtgggaagagctgtttatataaacagagattccgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgtagttcgagaataaaatgtgtggggttgggtcccctgcgcgcctgcggggaacgtaggcgggagtcgtgccccccagaccggtgttcgcatcgctggctcgccccttgactggctaagtggggcccggccccagctggatcgaagggcgggttgcagtcccgacacggctttaggaagatacctgggggatggaggggtggtgatgtcagggttgggcgcgggaagaaaaggagaggaggaagctgaggcaactttgggattcttgtcagcgggaggcgtcactggccccagagtgactccgactctccgctgggctcccagagctgctggcgtttcgaataccgaaaagtcaaccctgtggaccacgacagggcagaaggagtttctccggagatgagccggcgaggccaggtgcggggcgcgctgcaccggagcagcccaggccgggccgcaagctgtttccagagtgcaggagccaagtgctcggggaccctttgaaaagtgcctggggacctgaagagcaccggggaatttgtaacccctatttaagcctgcaagtgcctaagttaaaaaaaaaaaaaaaaaaaaaaaaaaaaaaaaaaaaaaaaaaaaaaaaaaaaaaa

SEQ ID NO: 96 - DNA, 4345 bp, Homo sapiens
actgaaactaggggcaaggagacgaagagaacatgaaagttaaactttaagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggatggctctgtgcggggggacccagccaacgtggagatcaccgagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctcatgtggattacaaaaaaaa

SEQ ID NO: 97 - DNA, 7556 bp, Homo sapiens
gcaggcgccttcgcggaccgagcctgacggagccggaggctgggagccgcggcggcctggggaagtgtttggattgtgagctatttcagaactgttctcaggactcattattttaacatttgggagaaacacagccagaagatgcacacttgactgaaggaggacagggaatctgaagactccggatgacatcagagctacttttcaacagccttctcaattttctttctcagaaagcagaggctcagagcttggagacagacgaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtc

SEQ ID NO: 98 - DNA, 2102 bp, Homo sapiens
ttgggggcggggcagaatcagcctttaagttgcagtgactctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtcaaaaaaaaaa

SEQ ID NO: 99 - DNA, 2692 bp, Homo sapiens
tttaaagctgggaggttctgccaccaagcacggccttcccactgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctaccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcgcctctgtcaaagatcggcatcgagctgacggattcaccctacgtggtggccagcatgcggatcatgacgcggatgggcacgcccgtcctggaagcagtgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggtgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatgtgtgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaa

SEQ ID NO: 100 - DNA, 3710 bp, Homo sapiens
aggacgcgtttccaagttccagtgactcctcctgtttgggactcggggggagagtgcggggagacaaataaaacctcgggcggcggcggctggtgggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgcaaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtatttttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctctaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaa

SEQ ID NO: 101 - DNA, 13037 bp, Homo sapiens
agtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggtatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatgcaaatagtattgtgggttttgtaggtttttaaaataaccttttttggggagagaattgtcctctaatgaggtattgcgagtggacataagaaatcagaagattatggcctaactgtactccttaccaactgtggcatgctgaaagttagtcactcttactgattctcaattctctcacctttgaaagtagtaaaatatctttcctgccaattgctcctttgggtcagagcttattaacatcttttcaaatcaaaggaaagaagaaagggagaggaggaggagggaggtatcaattcacatacctttctcctctttatcctccactatcatgaattcatattatgtttcagccatgcaaatctttttaccatgaaatttcttccagaattttccccctttgacacaaattccatgcatgtttcaaccttcgagactcagccaaatgtcatttctgtaaaatcttccctgagtcttccaagcagtaatttgccttctcctagagtttacctgccattttgtgcacatttgagttacagtagcatgttattttacaattgtgactctcctgggagtctgggagccatataaagtggtcaatagtgtttgctgactgagagttgaatgacattttctctctgtcttggtattactgtagatttcgatcattctttggttacatttctgcatatttctgtacccatgactttatcactttcttctcccatgctttatctccatcaattatcttcattacttttaaattttccacctttgcttcctactttgtgagatctctccctttactgactataacatagaagaatagaagtgtattttatgtgtcttaaggacaatactttagattccttgttctaagtttttaaactgaatgaatggaatattatttctctccctaagcaaaattccacaaaacaattatttcttatgtttatgtagccttaaattgttttgtactgtaaacctcagcataaaaactttcttcatttctaatttcattcaacaaatattgattgaatacctggtattagcacaagaaaaatgtgctaataagccttatgagaatttggagctgaagaaagacatataactcaggaaagttacagtccagtagtaggtataaattacagtgcctgataaataggcattttaatatttgtacactcaacgtatactaggtaggtgcaaaacatttacatataattttactgatacccatgcagcacaaaggtactaactttaaatattaaataacacctttatgtgtcagtaattcatttgcattaaatcttattgaaaaggctttcaatatattttccccacaaatgtcatcccaagaaaaaagtatttttaacatctcccaaatataatagttacaggaaatctacctctgtgagagtgacacctctcagaatgaactgtgtgacacaagaaaatgaatgtaggtctatccaaaaaaaaccccaagaaacaaaaacaatattattagccctttatgcttaagtgatggactcagggaacagttgatgttgtgatcattttattatctgattcttgttactttgaattaaaccaatattttgatgatataaatcatttccaccagcatatatttaatttccataataactttaaaattttctaatttcactcaactatgagggaatagaatgtggtggccacaggtttggcttttgttaaaatgtttgatatcttcgatgttgatctctgtctgcaatgtagatgtctaaacactaggatttaatatttaaggctaagctttaaaaataaagtacctttttaaaaagaatatggcttcaccaaatggaaaatacctaatttctaaatctttttctctacaaagtcctatctactaatgtctccattactatttagtcatcataaccattatcttcattttacatgtcgtgttctttctggtagctctaaaatgacactaaatcataagaagacaggttacatatcaggaaatacttgaaggttactgaaatagattcttgagttaatgaaaatattttctgtaaaaaggtttgaaaagccatttgagtctaaagcattatacctccattatcagtagttatgtgacaattgtgtgtgtgtttaatgtttaaagatgtggcactttttaataaggcaatgctatgctattttttcccatttaacattaagataatttattgctatacagatgatatggaaatatgatgaacaatattttttttgccaaaactatgccttgtaagtagccatggaatgtcaacctgtaacttaaattatccacagatagtcatgtgtttgatgatgggcactgtggagataactgacataggactgtgccccccttctctgccacttactagctggatgagattaagcaagtcatttaactgctctgattaaacctgcctttcccaagtgctttgtaatgaatagaaatggaaaccaaaaaaaacgtatacaggccttcagaaatagtaattgctactattttgttttcattaagccatagttctggctataattttatcaaactcaccagctatattctacagtgaaagcaggattctagaaagtctcactgttttatttatgtcaccatgtgctatgatatatttggttgaattcatttgaaattagggctggaagtattcaagtaatttcttctgctgaaaaaatacagtgttttgagtttagggcctgttttatcaaagttctaaagagcctatcactcttccattgtagacattttaaaataatgacactgattttaacatttttaagtgtctttttagaacagagagcctgactagaacacagcccctccaaaaacccatgctcaaattatttttactatggcagcaattccacaaaagggaacaatgggtttagaaattacaatgaagtcatcaacccaaaaaacatccctatccctaagaaggttatgatataaaatgcccacaagaaatctatgtctgctttaatctgtcttttattgctttggaaggatggctattacatttttagtttttgctgtgaatacctgagcagtttctctcatccatacttatccttcacacatcagaagtcaggatagaatatgaatcattttaaaaacttttacaactccagagccatgtgcataagaagcattcaaaacttgccaaaacatacattttttttcaaatttaaagatactctatttttgtattcaatagctcaacaactgtggtccccactgataaagtgaagtggacaaggagacaagtaatggcataagtttgtttttcccaaagtatgcctgttcaatagccattggatgtgggaaatttctacatctcttaaaattttacagaaaatacatagccagatagtctagcaaaagttcaccaagtcctaaattgcttatccttacttcactaagtcatgaaatcattttaatgaaaagaacatcacctaggttttgtggtttctttttttcttattcatggctgagtgaaaacaacaatctctgtttctccctagcatctgtggactatttaatgtaccattattccacactctatggtccttactaaatacaaaattgaacaaaaagcagtaaaacaactgactcttcacccatattataaaatataatccaagccagattagtcaacatccataagatgaatccaagctgaactgggcctagattattgagttcaggttggatcacatccctatttattaataaacttaggaaagaaggccttacagaccatcagttagctggagctaatagaacctacacttctaaagttcggcctagaatcaatgtggccttaaaagctgaaaagaagcaggaaagaacagttttcttcaataatttgtccaccctgtcactggagaaaatttaagaatttgggggtgttggtagtaagttaaacacagcagctgttcatggcagaaattattcaatacataccttctctgaatatcctataaccaaagcaaagaaaaacaccaaggggtttgttctcctccttggagttgacctcattccaaggcagagctcaggtcacaggcacaggggctgcgcccaagcttgtccgcagccttatgcagctgtggagtctggaagactgttgcaggactgctggcctagtcccagaatgtcagcctcattttcgatttactggctcttgttgctgtatgtcatgctgaccttattgttaaacacaggtttgtttgctttttttccactcatggagacatgggagaggcattatttttaagctggttgaaagctttaaccgataaagcatttttagagaaatgtgaatcaggcagctaagaaagcatactctgtccattacggtaaagaaaatgcacagattattaactctgcagtgtggcattagtgtcctggtcaatattcggatagatatgaataaaatatttaaatggtattgtaaatagttttcaggacatatgctatagcttatttttattatcttttgaaattgctcttaatacatcaaatcctgatgtattcaatttatcagatataaattattctaaatgaagcccagttaaatgtttttgtcttgtcagttatatgttaagtttctgatctctttgtctatgacgtttactaatctgcatttttactgttatgaattattttagacagcagtggtttcaagctttttgccactaaaaataccttttattttctcctcccccagaaaagtctataccttgaagtatctatccaccaaactgtacttctattaagaaatagttattgtgttttcttaatgttttgttattcaaagacatatcaatgaaagctgctgagcagcatgaataacaattatatccacacagatttgatatattttgtgcagccttaacttgatagtataaaatgtcattgctttttaaataatagttagtcaatggacttctatcatagctttcctaaactaggttaagatccagagctttggggtcataatatattacatacaattaagttatctttttctaagggctttaaaattcatgagaataaccaaaaaaggtatgtggagagttaatacaaacataccatattcttgttgaaacagagatgtggctctgcttgttctccataaggtagaaatactttccagaatttgcctaaactagtaagccctgaatttgctatgattagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcgtggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatgatcataaacatgaagaattgtaggtgatcatgacctcctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccaggtcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagcctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccgttgcttattagtaaaactagtgttaatacttggcaagagatgcagggaatctttctcatgactcacgccctatttagttattaatgctactaccctattttgagtaagtagtaggtccctaagtacattgtccagagttatacttttaaagatatttagccccatatacttcttgaatctaaagtcatacaccttgctcctcatttctgagtgggaaagacatttgagagtatgttgacaattgttctgaaggtttttgccaagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttcta

SEQ ID NO: 102 - DNA, 2693 bp, Homo sapiens
ggaagctggagccacctgcggctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaaaaaaaaaaaaaaaa

SEQ ID NO: 103 - DNA, 3508 bp, Homo sapiens
aagccccgccccgcgccctgcgtcgggttaagagggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcctgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccatcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcaggtaggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaacaaaaaaaaaaaaaaaaaa

SEQ ID NO: 104 - DNA, 1295 bp, Homo sapiens
ccttcccctggcccggggagctgctccttgtgctgccgggaaggtcaaagtcccgcgcccaccaggagagctcggcaagtatataaggacagaggagcgcgggaccaagcggcggcgaaggaggggaagaagagccgcgaccgagagaggccgccgagcgtccccgccctcagagagcagcctcccgagacaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatccacctctgactttgaatgtaaactgtgtgaataaagtaaaaatacgtagccgtcaaataacagc

SEQ ID NO: 105 - DNA, 1818 bp, Homo sapiens
ggcgcccgcgcccgcccccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagta

SEQ ID NO: 106 - DNA, 6318 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacgcttaaaacctagaacttcaaaatgttcgtattctattcaaaaggaaatatatatatatatatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatcta

SEQ ID NO: 107 - DNA, 4790 bp, Homo sapiens
ggggaagcgcagtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctgaatttgtagttgttggtttattttaatggtatgtacaagttgagtatcccttatccaaaatgcttgggaccagaagtgtttcagattttttaaaattttggaatatttgctttatactgagcttttgagtgttcccaatctgaaattcaaaatgctctaatgagcatttcctttgagcatcatgcctgctctgaaaaagtttctgattctggagcattttggattttggattttcagattagggatgcttaacctggattaacattctgttgtgccatgatcatgctttacagtgagtgtattttatttatttattattttgtttgtttgtttgagatggagtctcactctgtcatccaggctagagtgcagtggcgtgatctcggctgactgcaacctctgcctcccgggttcaagtgattctcctgcctcaatctctctccccagaagctgggattacaggtgtgtgccaccacacccggctaatttttttttttttttttgagatggagtctagctctgtcatccaggctggagtgcagtggtgtgatctcggctccctgcaacctctgccttctgggttcctgcgattctcctgcctcagcctcctgagtagctgagattacaggcacgcgccactgtgcccagccaatttttgtatttttagtagagatggggtttcacatgtcagtcatgctggtcttgatctcctgacctcgtgatccacccgcctcgacctcccaaagtactgggattacaggcgtgagccaccgcatccggcctgagttttatgctttcaatgtatttcttacatttcagttcaagtgattttcatgtctcagcctcctgagtagctggaactacaggtgcgtgccaccatgcctggctaagttttgtatttttagtagagatgggttttcatcatgttggccaagatggtcttgatctcttgacctcatgatccaccagcctaggcctcccaaagtgctgggattacaggtgtgagccaccgtgcccagccaactatgccattatttaaccatgtccacacattctggttattttcaatattttgcagaagataattcttgatcggtgtgtcttatgccacaaggattaaaatatgtattcattgctacaaaacaatatctcgaaatttagcagtttaaaacaacaaatattatctccagtttctgagcctcagaaatctgagagtggtttagctgggtgatagtctcgtggttttggtcaagctaccaaccagggctacaatctttcgaaggtgtcattggggctagaagatctgcttcccgcaagactcacagctgttggcaggagacctcagtttgttgccacatgttcccctccagagggcctctcacaacatggcagttatttgtccccagagcaagcaacaccggagggcaaggaagaagccatgatgttttttgtaacctagcctctgaaagtgtcataccaattctgtattttgttggtcacacagaccaagtcaactacaacgtgggagactcctacacaaggcatgaattctaggaggtgggcatttttaagtgtcatctggaaggaggctgtcacaacctggaagttaaaagcattgatattctgaaatacagcgtgtataacattgttttagtagggtgtgcaatagttatgttttggtaatagcattaatgaacaatgttattttcatcttccagacatctggaagattgctctagtggagtaaaacatcttaatgtattttgtccctaaataaactatctcactaacaaaaaaaaaaaaaaa

SEQ ID NO: 108 - DNA, 4881 bp, Homo sapiens
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggca

SEQ ID NO: 109 - DNA, 1641 bp, Homo sapiens
agagggcccgctcaccaccccgtaggccccgcccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgacgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccagtaaaaaaaaaaaaaaaa

SEQ ID NO: 110 - DNA, 7957 bp, Homo sapiens
gcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 111 - DNA, 3773 bp, Homo sapiens
atccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgctaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggtggggggcatcctcctccctgccccagagctttgccagagtgactacctccatgaccgtggccatccacccaccccccctgcctggtgcctacatccatccagcccctgatgagcccccttggtcccctgctgccactagctctggcaacctcagttccaggggaccaggtccagccactgggtgaaagagcagctgaagcacagagaccatgtgtggggcgtgtggggtcactgggaagcactgggtctggtgttagacgcaggatggacccctggagggccctgctgctgctgcatcccctctcccgacccagctgtcatgggcctccctgat

SEQ ID NO: 112 - DNA, 1223 bp, Homo sapiens
cccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacaaaaaaaaaaaaaaaaaa

SEQ ID NO: 113 - DNA, 1785 bp, Homo sapiens
aggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcacttaaaaaaaaaaaaaaaaaaa

SEQ ID NO: 114 - DNA, 6582 bp, Homo sapiens
agagggcaaggagagagcagagaacacactttgccttctctttggtattgagtaatatcaaccaaattgcagacatctcaacactttggccaggcagcctgctgagcaaggtacctcagccagcatggcagcctctttcccacccaccttgggactcagttctgccccagatgaaattcagcacccacatattaaattttcagaatggaaatttaagctgttccgggtgagatcctttgaaaagacacctgaagaagctcaaaaggaaaagaaggattcctttgaggggaaaccctctctggagcaatctccagcagtcctggacaaggctgatggtcagaagccagtcccaactcagccattgttaaaagcccaccctaagttttcaaagaaatttcacgacaacgagaaagcaagaggcaaagcgatccatcaagccaaccttcgacatctctgccgcatctgtgggaattcttttagagctgatgagcacaacaggagatatccagtccatggtcctgtggatggtaaaaccctaggccttttacgaaagaaggaaaagagagctacttcctggccggacctcattgccaaggttttccggatcgatgtgaaggcagatgttgactcgatccaccccactgagttctgccataactgctggagcatcatgcacaggaagtttagcagtgccccatgtgaggtttacttcccgaggaacgtgaccatggagtggcacccccacacaccatcctgtgacatctgcaacactgcccgtcggggactcaagaggaagagtcttcagccaaacttgcagctcagcaaaaaactcaaaactgtgcttgaccaagcaagacaagcccgtcagcgcaagagaagagctcaggcaaggatcagcagcaaggatgtcatgaagaagatcgccaactgcagtaagatacatcttagtaccaagctccttgcagtggacttcccagagcactttgtgaaatccatctcctgccagatctgtgaacacattctggctgaccctgtggagaccaactgtaagcatgtcttttgccgggtctgcattctcagatgcctcaaagtcatgggcagctattgtccctcttgccgatatccatgcttccctactgacctggagagtccagtgaagtcctttctgagcgtcttgaattccctgatggtgaaatgtccagcaaaagagtgcaatgaggaggtcagtttggaaaaatataatcaccacatctcaagtcacaaggaatcaaaagagatttttgtgcacattaataaagggggccggccccgccaacatcttctgtcgctgactcggagagctcagaagcaccggctgagggagctcaagctgcaagtcaaagcctttgctgacaaagaagaaggtggagatgtgaagtccgtgtgcatgaccttgttcctgctggctctgagggcgaggaatgagcacaggcaagctgatgagctggaggccatcatgcagggaaagggctctggcctgcagccagctgtttgcttggccatccgtgtcaacaccttcctcagctgcagtcagtaccacaagatgtacaggactgtgaaagccatcacagggagacagatttttcagcctttgcatgcccttcggaatgctgagaaggtacttctgccaggctaccaccactttgagtggcagccacctctgaagaatgtgtcttccagcactgatgttggcattattgatgggctgtctggactatcatcctctgtggatgattacccagtggacaccattgcaaagaggttccgctatgattcagctttggtgtctgctttgatggacatggaagaagacatcttggaaggcatgagatcccaagaccttgatgattacctgaatggccccttcactgtggtggtgaaggagtcttgtgatggaatgggagacgtgagtgagaagcatgggagtgggcctgtagttccagaaaaggcagtccgtttttcattcacaatcatgaaaattactattgcccacagctctcagaatgtgaaagtatttgaagaagccaaacctaactctgaactgtgttgcaagccattgtgccttatgctggcagatgagtctgaccacgagacgctgactgccatcctgagtcctctcattgctgagagggaggccatgaagagcagtgaattaatgcttgagctgggaggcattctccggactttcaagttcatcttcaggggcaccggctatgatgaaaaacttgtgcgggaagtggaaggcctcgaggcttctggctcagtctacatttgtactctttgtgatgccacccgtctggaagcctctcaaaatcttgtcttccactctataaccagaagccatgctgagaacctggaacgttatgaggtctggcgttccaacccttaccatgagtctgtggaagaactgcgggatcgggtgaaaggggtctcagctaaacctttcattgagacagtcccttccatagatgcactccactgtgacattggcaatgcagctgagttctacaagatcttccagctagagataggggaagtgtataagaatcccaatgcttccaaagaggaaaggaaaaggtggcaggccacactggacaagcatctccggaagaagatgaacctcaaaccaatcatgaggatgaatggcaactttgccaggaagctcatgaccaaagagactgtggatgcagtttgtgagttaattccttccgaggagaggcacgaggctctgagggagctgatggatctttacctgaagatgaaaccagtatggcgatcatcatgccctgctaaagagtgcccagaatccctctgccagtacagtttcaattcacagcgttttgctgagctcctttctacgaagttcaagtataggtatgagggaaaaatcaccaattattttcacaaaaccctggcccatgttcctgaaattattgagagggatggctccattggggcatgggcaagtgagggaaatgagtctggtaacaaactgtttaggcgcttccggaaaatgaatgccaggcagtccaaatgctatgagatggaagatgtcctgaaacaccactggttgtacacctccaaatacctccagaagtttatgaatgctcataatgcattaaaaacctctgggtttaccatgaaccctcaggcaagcttaggggacccattaggcatagaggactctctggaaagccaagattcaatggaattttaagtagggcaaccacttatgagttggtttttgcaattgagtttccctctgggttgcattgagggcttctcctagcaccctttactgctgtgtatggggcttcaccatccaagaggtggtaggttggagtaagatgctacagatgctctcaagtcaggaatagaaactgatgagctgattgcttgaggcttttagtgagttccgaaaagcaacaggaaaaatcagttatctgaaagctcagtaactcagaacaggagtaactgcaggggaccagagatgagcaaagatctgtgtgtgttggggagctgtcatgtaaatcaaagccaaggttgtcaaagaacagccagtgaggccaggaaagaaattggtcttgtggttttcatttttttcccccttgattgattatattttgtattgagatatgataagtgccttctatttcatttttgaataattcttcatttttataattttacatatcttggcttgctatataagattcaaaagagctttttaaatttttctaataatatcttacatttgtacagcatgatgacctttacaaagtgctctcaatgcatttacccattcgttatataaatatgttacatcaggacaactttgagaaaatcagtccttttttatgtttaaattatgtatctattgtaaccttcagagtttaggaggtcatctgctgtcatggatttttcaataatgaatttagaatacacctgttagctacagttagttattaaatcttctgataatatatgtttacttagctatcagaagccaagtatgattctttatttttactttttcatttcaagaaatttagagtttccaaatttagagcttctgcatacagtcttaaagccacagaggcttgtaaaaatataggttagcttgatgtctaaaaatatatttcatgtcttactgaaacattttgccagactttctccaaatgaaacctgaatcaatttttctaaatctaggtttcatagagtcctctcctctgcaatgtgttattctttctataatgatcagtttactttcagtggattcagaattgtgtagcaggataaccttgtatttttccatccgctaagtttagatggagtccaaacgcagtacagcagaagagttaacatttacacagtgctttttaccactgtggaatgttttcacactcatttttccttacaacaattctgaggagtaggtgttgttattatctccatttgatgggggtttaaatgatttgctcaaagtcatttaggggtaataaatacttggcttggaaatttaacacagtccttttgtctccaaagcccttcttctttccaccacaaattaatcactatgtttataaggtagtatcagaatttttttaggattcacaactaatcactatagcacatgaccttgggattacatttttatggggcaggggtaagcaagtttttaaatcatttgtgtgctctggctcttttgatagaagaaagcaacacaaaagctccaaagggccccctaaccctcttgtggctccagttatttggaaactatgatctgcatccttaggaatctgggatttgccagttgctggcaatgtagagcaggcatggaattttatatgctagtgagtcataatgatatgttagtgttaattagttttttcttcctttgattttattggccataattgctactcttcatacacagtatatcaaagagcttgataatttagttgtcaaaagtgcatcggcgacattatctttaattgtatgtatttggtgcttcttcagggattgaactcagtatctttcattaaaaaacacagcagttttccttgctttttatatgcagaatatcaaagtcatttctaatttagttgtcaaaaacatatacatattttaacattagtttttttgaaaactcttggttttgtttttttggaaatgagtgggccactaagccacactttcccttcatcctgcttaatccttccagcatgtctctgcactaataaacagctaaattcacataatcatcctatttactgaagcatggtcatgctggtttatagattttttacccatttctactctttttctctattggtggcactgtaaatactttccagtattaaattatccttttctaacactgtaggaactattttgaatgcatgtgactaagagcatgatttatagcacaacctttccaataatcccttaatcagatcacattttgataaaccctgggaacatctggctgcaggaatttcaatatgtagaaacgctgcctatggttttttgcccttactgttgagactgcaatatcctagaccctagttttatactagagttttatttttagcaatgcctattgcaagtgcaattatatactccagggaaattcaccacactgaatcgagcatttgtgtgtgtatgtgtgaagtatatactgggacttcagaagtgcaatgtatttttctcctgtgaaacctgaatctacaagttttcctgccaagccactcaggtgcattgcagggaccagtgataatggctgatgaaaattgatgattggtcagtgaggtcaaaaggagccttgggattaataaacatgcactgagaagcaagaggaggagaaaaagatgtctttttcttccaggtgaactggaatttagttttgcctcagatttttttcccacaagatacagaagaagataaagatttttttggttgagagtgtgggtcttgcattacatcaaacagagttcaaattccacacagataagaggcaggatatataagcgccagtggtagttgggaggaataaaccattatttggatgcaggtggtttttgattgcaaatatgtgtgtgtcttcagtgattgtatgacagatgatgtattcttttgatgttaaaagattttaagtaagagtagatacattgtacccattttacattttcttattttaactacagtaatctacataaatatacctcagaaatcatttttggtgattattttttgttttgtagaattgcacttcagtttattttcttacaaataaccttacattttgtttaatggcttccaagagccttttttttttttgtatttcagagaaaattcaggtaccaggatgcaatggatttatttgattcaggggacctgtgtttccatgtcaaatgttttcaaataaaatgaaatatgagtttcaatactttttatattttaatatttccattcattaatattatggttattgtcagcaattttatgtttgaatatttgaaataaaagtttaagatttgaaaa

SEQ ID NO: 115 - DNA, 2457 bp, Homo sapiens
attagatcagtgttcataagaacatctgtaggcacacatacacactctctttacagtcagccttctgcttgccacagtcatagtgggcagtcagtgaatcttccccaagtgctgacaattaatacctggtttagcggcaaagattcagagaggcgtgagcagcccctctggccttcagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaagtatgggtgttctctttggaggacgctcatacatgccttctacccacagaaccacagaaaaatggaatagtgtagctgactgcctgccctgtgttttcctggtggattttgaatttgggtgtgctacatcatacattcttccagaacttcaggatgggctatcttttcatgtctctattgccaaaaatgacaccatctatattttaggaggacattcacttgccaataatatccggcctgccaacctgtacagaataagggttgatcttcccctgggtagcccagctgtgaattgcacagtcttgccaggaggaatctctgtctccagtgcaatcctgactcaaactaacaatgatgaatttgttattgttggtggctatcagcttgaaaatcaaaaaagaatgatctgcaacatcatctctttagaggacaacaagatagaaattcgtgagatggagaccccagattggaccccagacattaagcacagcaagatatggtttggaagcaacatgggaaatggaactgtttttcttggcataccaggagacaataaacaagttgtttcagaaggattctatttctatatgttgaaatgtgctgaagatgatactaatgaagagcagacaacattcacaaacagtcaaacatcaacagaagatccaggggattccactccctttgaagactctgaagaattttgtttcagtgcagaagcaaatagttttgatggtgatgatgaatttgacacctataatgaagatgatgaagaagatgagtctgagacaggctactggattacatgctgccctacttgtgatgtggatatcaacacttgggtaccattctattcaactgagctcaacaaacccgccatgatctactgctctcatggggatgggcactgggtccatgctcagtgcatggatctggcagaacgcacactcatccatctgtcagcaggaagcaacaagtattactgcaatgagcatgtggagatagcaagagctctacacactccccaaagagtcctacccttaaaaaagcctccaatgaaatccctccgtaaaaaaggttctggaaaaatcttgactcctgccaagaaatcctttcttagaaggttgtttgattagttttgcaaaagcctttcagattcaggtgtatggaatttttgaatctatttttaaaatcataacattgattttaaaaatacatttttgtttatttaaaatgcctatgttttcttttagttacatgaattaagggccagaaaaaagtgtttataatgcaatgataaataaagtcattctagaccctatacattttgaaaatattttacccaaatactcaatttactaatttattcttcactgaggatttctgatctgattttttattcaacaaaccttaaacacccagaagcagtaataatcatcgaggtatgtttatatttattatataagtcttggtaacaaataacctataaagtgtttatgacaaatttagccaataaagaaattaacacccaaaagaattaaattgattattttgtgcaacataacaattcggcagttggccaaaacttaaaagcaagatctactacatcccacattagtgttctttatataccttcaagcaaccctttggattatgcccatgaacaagttagtttctcatagctttacagatgtagatataaatataaatatatgtatacatatagatagataatgttctccactgacacaaaagaagaaataaataatctacatcaaaaaaaaaaaaaaaaaaaaaaaaaaaa

SEQ ID NO: 116 - DNA, 3301 bp, Homo sapiens
gtgcctcttgcagcagcctaacccagaagcaggggggaatcctgaatcgagctgagagggcttccccggttctcctgggaaccccatcggccccctgccagcacacacctgagcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaa

SEQ ID NO: 117 - DNA, 4903 bp, Homo sapiens
gtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaattaaaaaaaaaaaaaaaaaa

SEQ ID NO: 118 - DNA, 812 bp, Homo sapiens
gatataaagctcctactctgtctgacctgacaagccacctcaagtggacaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttatttttatccagtgaaaaaa

SEQ ID NO: 119 - DNA, 4573 bp, Homo sapiens
agaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaaaaaaaaaaaaaaaaa

SEQ ID NO: 120 - DNA, 450 bp, Homo sapiens
gtccaaacacacacatctcactcatccttctactcgtgacgcttcccagctctggctttttgaaagcaaagatgagcaacactcaagctgagaggtccataataggcatgatcgacatgtttcacaaatacaccagacgtgatgacaagattgagaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccagaaaaaaaaaaaa

SEQ ID NO: 121 - DNA, 586 bp, Homo sapiens
aaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaagtcaaaaaaaaaa

SEQ ID NO: 122 - DNA, 5189 bp, Homo sapiens
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtccagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccatggacctgggccagctctgtgagggctttacccttccacccgaaggacatcatgggggcattcagccactcagaaatgcagatgattaaccaatattgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacagcatttaaagttgtataaaaacatgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttattttagactcaaagaatataatctggcactactcagttattactgtttgttctcttattccctagtctgtgtggcaaattaaacaatataagaaggaaaaatttgaagtattagacttctaaataaggtgtgaaatcatcaaaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattccccaaaaaaaaaaaaaaaa

SEQ ID NO: 123 - DNA, 2164 bp, Homo sapiens
ataaatatcagagtgtgctgctgtggctttgtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 124 - DNA, 3212 bp, Homo sapiens
gaacccggtggctgcacagacaaaaaagccccgaatggctggagggcgttcagctgttaacagccttttggggcagagcacggatttgacagctccacaacgtgaggatatccactgaccccgcgagacggaggagaacgcttccccgaaattctctgcccaccaaagccagcgctgcaaggttgcaactttcaaactttgtttttccagaaagaagactgccctttcgtgtacaaggagagggtgagagggtgacctagcttgtagatcggctgaaggcaccagtggttccaaatgtcacccagatgtgtgttttcatgacgatttgatttctctgattttatttttacatttttcattttaaaaatacaaagcaatttttttggggcatgctgaaaggtaactgaagaccgcaaaggaaaaactattgtcatggctgaaggagagaatgaagtgagatgggatggactctgcagcagagattcaactactagggagacagcattggaaaacattaggcaaaccattttgaggaaaaccgagtatcttcgttcggtgaaagaaacacctcatcgtccatcagacgggctttcaaataccgagtcttcggatgggttgaataagctacttgctcatctgcttatgctttctaagaggtgtcccttcaaagatgtgagagagaaaagtgagtttattctgaagagcatccaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctccaattttaaaaaaaaaaaaaaaaaa

SEQ ID NO: 125 - DNA, 4206 bp, Homo sapiens
ggggcctgcaggtttggcccccgcagggagcgcagctggcgccgctgggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaaaaaaaaaaaaaaa

SEQ ID NO: 126 - DNA, 4110 bp, Homo sapiens
gtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttaaaaaaaaaaaaaaaaa

SEQ ID NO: 127 - DNA, 12021 bp, Homo sapiens
gggtgatgtcagctctcgacgaaaatagagagggatcgcctgcaaatccccagctccggcggggctaaaccttgcaatccctccctggccggcgccgagccagagcgcagcggcctccaccgcctccccaggcgcgcacacacccgcacacgcgcacgcacgctcaccgtcctctgccaccactctctgctcccgccactcgccgcgcccgcgagccccgcagcaaagcacaggtggcagcggctgcaggggcgcatcgccggcgtgcgccctcctgcagccctgggcgcatcgctctctcggggaagccaccctcggagcccccggagctccccgccaagcgccatccccgcgggcggaggggagcgcgggtcgcgcgccgtggagagccgggacgcggattagcgcccgcaggagcctcctgcgcccgttgaggcgctaaagggcttaccccggaggcgggtggaagggcgggcagaggctcctcttaaataccgctcccggccgcacttcgcgctcaccccggcgtccgctttctccctcgcccacagctgccggatagtgctgaagaggagggggcgttccccagaccatggcatctacggaaggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattatatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcggaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcagtatctgtagtaatttctggttaagcctagagggatcactgagtgccaatccaagcaggtggcactagaggcagattgttctcctagcatagagtgagtttccagctgctcatgacacattttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtacaacacttgcacaatcacggcaactgtttgtaaatatcttttcttctccgccagtatgtagacatgcacacccattcacaagtaagcccgcaaattcattttcacattttcctcttggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaatttaaaaaaaaaaaaaaaa

SEQ ID NO: 128 - DNA, 11623 bp, Homo sapiens
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggggttggtacagtaggcttcactagacttagctgcaactcagaatttctcctccagcacctgagtaaatgctgatggtcttgtggagagtggattaagagtacgagctaagttctcaatcccaattaagaagcggaaaatttaaactgtcttcttcaaagtttatcacaaccaccaccatcaagacagcaaaccaaaggacaaagactttgaccctgctgtgttgctctgtgtagtccagttcacgtatggtttacagacttggctggggttactaaaaataaataaaaagttggacacttctgtcattggagcgctattattcacaagttaccagaatgagagctgtactggacacagcagacattgccatagtggccctgtattttatcctggtcatgtgcattggtttttttgccatgtggaaatctaatagaagcaccgtgagtggatacttcctggcggggcgctctatgacctgggtagcaattggtgcctctctgtttgtgagcaatattgggagtgagcacttcattgggctggcaggatctggagctgcaagtggatttgcagtgggcgcatgggaattcaatgccttactgcttttacaacttctgggatgggttttcatcccaatttacatccggtcaggggtatataccatgcctgaatacttgtccaagcgatttggtggccataggattcaggtctattttgcagccttgtctctgattctctatattttcaccaagctctcggtggatctgtattcgggtgccctttttatccaggagtctttgggttggaatctttatgtgtctgtcatcctgctcattggcatgactgctttgctgactgtcaccggaggccttgttgcagtgatctacacagacactctgcaggctctgctcatgatcattggggcacttacacttatgattattagcataatggagattggcgggtttgaggaagttaagagaaggtacatgttggcctcacccgatgtcacttccatcttattgacatacaacctttccaacacaaattcttgtaatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtccttgcagccaaaaacattgctcatgccaaaggctctactcttatggctggcttcttaaagctcctgccaatgtttatcatagttgtcccaggaatgatttccaggatactgtttactgatgatatagcttgcatcaacccagagcactgcatgctggtgtgtggaagcagagctggttgctccaatattgcttacccacgcctggtgatgaagctggttcctgtgggccttcggggtttaatgatggcagtgatgattgcagctctgatgagtgacttagactctatctttaacagtgccagtaccatattcaccctcgatgtgtacaaacttatccgcaagagcgcaagctcccgggagttaatgattgtggggaggatatttgtggcatttatggtggtgatcagcatagcatgggtgccaatcatcgtggagatgcaaggaggccagatgtacctttacattcaggaggtagcagattacctgacacccccagtggcagccttgttcctgctggcaattttctggaagcgctgcaatgaacaaggggctttctatggtggaatggctggctttgttcttggagcagtccgtttgatactggcctttgcctaccgtgccccagaatgtgaccaacctgataataggccgggcttcatcaaagacatccattatatgtatgtggccacaggattgttttgggtcacgggactcattactgtaattgtgagccttctcacaccacctcccacaaaggaacagattcgaaccaccaccttttggtctaagaagaacctggtggtgaaggagaactgctccccaaaagaggaaccatacaaaatgcaagaaaagagcattctgagatgcagtgagaataatgagaccatcaaccacatcattcccaacgggaaatctgaagacagcattaagggccttcagcctgaagatgttaatctgttggtaacctgcagagaggagggcaacccagtggcatccttaggtcattcagaggcagaaacaccagttgacgcttactccaatgggcaagcagctctcatgggtgagaaagagagaaagaaagaaacggatgatggaggtcggtactggaagttcatagactggttttgtggctttaaaagtaagagcctcagcaagaggagtctcagagacctgatggaagaggaggctgtttgtttacagatgctagaagagactcggcaagttaaagtaatactaaatattggactttttgctgtgtgttcacttggaattttcatgtttgtttatttctccttatgaacttaaggatatggtgagacactaacttaagacaatactgactggtctttggggaaaaaagttatgtaactgtgcatctctcaggcattgtttacgctgtaggttttagccaaattttacttagcagaaaatcatctaattacaagactttattttcccagagatggattaaagtaaatcttcaacttaagtgaagccaaacctaacagactgaattgtgcaaatgtggttttaaattttgcataccaaagtaagaagagaccaattattctcacagagcacttagagcagaatatatgttaagttaccatgaattaaggtatactgtctgcactgccaagtcttggcagaccttaccctgaagtagaagatttgctcatttctaaatttttttttctgtctctgtaatccctcctaccattaagaaaaacttatttcttagacattgtacaatcagttatgtactgaaaatcgaatgtgcttgtgtgatacttgtttcaggacaagttcatttgccaggttcattttgttagcatgagcctacggattctgatttcccaaagaaagaatgttttcctgtaggtatttttgtaccaccagtatatggaatgttagggaaaaactttgttccagttcctttttttttttctttctactttcaagtttaagtgaaccatactgaaatgaccaacaagtctgcctgtaaagttacatgtcatgattgtgttgttaaatgattatgggggagaaaatgaagtaaatgttgctgatgatccccatatttattgatcatattaaggttgtttatatagtttggaaatgaccagccccctaagcagtgtttgattaacttatgctaatcagatgattactcatatattctgctaattttctagctttattcttgttatttggaaaaattattagccaaatgccttcctaggtggatccagttggaagatatgtccagaaacctgaagaaaaattgacgctgcctttgtgtgctggattgctctacttgattagatcatgatatatcaaggttgaatttttagagggaaaatttaattctgatatcttattgcatccttgataagtttttccctgattttttttttcctcaaaagactttccatctgtacacagcctctacatttttgttgtagtgacttagagcataaggatgtttcagtgcaaactggccgtcggtaacagaaaactcagtgcatactttgctgttgttaggttgtcaatatagtctttctgtaggatggatagcatgtttgagaggtgccaaacaagaacttttggggttagtagtgtgtcttgtggagggtattacaggactgtgtaattataggactctaacttgacatggcttggcacccacttgcagctagtgggtacagggtacaaaagatgttagagaaaagctctacagattacgtacttctgtgtcttcgtatgctcaacactgtcctttgtcctccatgaaagatgaaggaagcaaattatgtatgtactttctttgaccttctttaatctctgatactttttagattgcatgattttactaggcttgtatttagggaaattactttcataaatacttttgtagattttgaatcaaaactcagtctttttaatttttttgtagtctataaactagtttcattatgatggacttgattagtccaaagttaattttagaaattgtcaggtagcatagtgtcttcccatgatcaggaggctttctgaaggactgagtctgtaaatgaaaaaataatttatgtatgaatagcatgtatttctgaagagcttagagtgccttgtagaatttttttctcaattttattcttgaggtttataatttgggggccaaatagatagagctcatcattttcttgtttggaagttgaggctgcgacatgtccaaggttatgaagtctcttttgggaagaacagaaaccaggtctccaaatctggactcatggtttgttcagatgtgtctggacaaatggttgtcaatgttttgtcctgttttttcaaaggaactgttcttcctttgggacaaccttttggtgtttgggaaagtaataagatcttggatttttcaaattaacattaagttgtaagaactaaaattttctttgaaccacattactgtgtaattcactgataattgacatattggctgggcagcctatctcttccatatccagcgtaaatgaataggaggtgtttgtgattttttttttctccctttatttaacattgagtcctagtagtttggagaattagggtccctctaccttctttctgctcttgtcttagtaagatacataaggtacatcatcttgtgtctgtgtgtatatagcagtaggtcaagtttagagtactaaagtctgtaaataaggaatgactattagcatattcattagaattgtttattcttgccagtataaacatcattttatttagactaaagtccctgaagcttgtctttcttattgcttcccagtaatagataatgtgctcgagtaagtttgtgaattgctgattgcaacttaattcagggaccagtcttcaatctatatttcattagaatgattgttcctggaatgatcatacatggactgtcttaagctagcaaaatgttcatactttacactgactaaatgggtcctaaatgatgacattggtctttagacattaacatgtgtatatttttatattagctcaagctaaggttcagaattgaagcttgatattgactagaatagctaaaagtcaaaatgaggtgaggacactggtcttggaaggtagagaaaaataaatgtcttaccaggtgttaatggtatccccagttcttagacttttgtcttctcaggcaattttcatctcaagatctgatgagaagggcatattacattggtatgcaggatgattattgcatattttgtgggacctctaatttccctggtcatctttcagaatattctgttctgccacccccagagagtaaacacttgagccgatttcttcttccccagctattctttcctgggggtaattatgctttgtctttagattagagaagcatcaagcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctgtcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccaacctaatttatcttggtaaattcaccctgtttcctagtgctgctggataaaagagtgtttactttttattgctcttagacagagtagtctagataagttttcaatttatcaacatagcctagacttctgtaagtggaatgttcattagtaactcatctttttgttgttataattggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttcttaacagaaaatttgtatttgttattcctcttaaattttgtcgtaactagtgaaggaagtaaaaaaaaaaaaaaaacatgcattacattgacatactttatgtgcagcctttatttaggttcagtgaaaccaggtagttctgtatttgtgttgtagcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcttgccagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttata

SEQ ID NO: 129 - DNA, 8789 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaaaaaaaaaaaaa

SEQ ID NO: 130 - DNA, 981 bp, Homo sapiens
gtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaaaaaaaaaaaaaaaaa

SEQ ID NO: 131 - DNA, 1593 bp, Homo sapiens
gcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagtt

SEQ ID NO: 132 - DNA, 3963 bp, Homo sapiens
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaaaaaaaaaaaaaaaaaaaaaaaaaaaaaa

SEQ ID NO: 133 - DNA, 1963 bp, Homo sapiens
cggggcgagcgagcggggcgcggcgaggggcaagggcggggagggccccggcgctcagagcaggcgccagggaggcaggctgggcggcccttcgtcctcgccttcgggtgtccatgcctcggcggcggcgtcccgctccgcagccaggggcctgcaagccgtagccatggccgcggtggccgtcctccggaacgactcgctgcaggcctttctccaggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtgagccctcccggaggtggacccccttcccagcacctctgcgagagatccggggacctgtgggcagctggcggaggggagactcagcagacggaccctctccgttgcctgcctcccaaaatggagccaggcttccaacttccgctgccttcggacatagggacccagttcccaggagcggggaggtagggttggggctggggcatttggattgtaattgggagctctgccgtacgccagggcggttccaaactctaaaccgttcccaccgtcagggagacctacagtttcgggggaccaccctggtctggccttgtatataggaaatgctgctgaactgaatagaaaggaacttgggagatttgaaacagtgctcgggttttcgctaggaccggtttgggctttgtacaggttatttaatagctttgttaaagataattataataattataacattaataaaaatgttgcttttgtcttcagctccatgcagagctacagcatgatatgtctctgtaaagtgatcagcagttgcagcgtgaaaataaatactttaactcaggggtcactacaggaagaccccgttgaaaaaaaaaaaaaaaaa

SEQ ID NO: 134 - DNA, 1616 bp, Homo sapiens
ctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaaaaaaaaaaaaaaaaaaaaaaaaaaaaaaaaaa

SEQ ID NO: 135 - DNA, 3286 bp, Homo sapiens
gcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctgaaaaaaaaaa

SEQ ID NO: 136 - DNA, 4814 bp, Homo sapiens
gaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctaaaaaaaaaaaaaaaaaaaaaaaaaaaaaaa

SEQ ID NO: 137 - DNA, 1661 bp, Homo sapiens
cggccgctgggtccgtgaaggggagtgaggcactcctcaccctgtggcagctcctagtcaggaggcctctcccctccacctgcacgtcatgtggctgtggctcccaggaccagcgcctggagcgggtgagtgaacgtccctctcctccgtgggcactgcctccgctgtgagccacccttcaggctacgtgcatttccgcctgttctcagggtttaaccgaaaccgaacattaaccgtagccctaacgcggctgagggatccaggccttgcctctgggccgggtgagagacagacactcgccaaccagtccgcagtggctccccgtgtgtgcgaggctcccgcctgcgtgtgtgcgtgtgcatgtgtgcctgcgcacaggggagggaaagttcttcagctgccgagggcgggagtaggggctggagcagcaccctgcggcgaggccccacaggagaatcgatggttctgatgctgtcagcctctgggtgcaaattctgagggcccgggagcgtctggcggccctgagcagcttgctggggaagctccgtggaggaggaagtccggaggcatgtgatgtgaatcagctgacatcatcttgacgggagccctgtgaggcggacacttaactccagtttcacaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaacaaaaaaaaaaaaaaaaaa

SEQ ID NO: 138 - DNA, 4004 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 139 - DNA, 2174 bp, Homo sapiens
aatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaaaaaa

SEQ ID NO: 140 - DNA, 508 bp, Homo sapiens
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaa

SEQ ID NO: 141 - DNA, 5174 bp, Homo sapiens
ggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagtatgcttatttttctaattctttgtcttgatgacattagtttattttttatctttggctgtgccactcctatatattaaaaatgcctagttttttcaagggagattgttgttaaagtaaagtggttttttttgttgttaaa

SEQ ID NO: 142 - DNA, 1953 bp, Homo sapiens
acagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaagacttctaatctttttttcataatatctttgacacatattacagaagaaataaatttcttacttttaatttaatatga

SEQ ID NO: 143 - DNA, 2396 bp, Homo sapiens
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaaaaaaaaa

SEQ ID NO: 144 - DNA, 5744 bp, Homo sapiens
gtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtata

SEQ ID NO: 145 - DNA, 3214 bp, Homo sapiens
gtggcgtgccggccaatcggcgcagctctttcctgcatatattttgcactaagactgggagtcctggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctgatttccactttaagaaccctgtcaccctgggttgggatgtttctcctagtgtaggatgagtttctagctcctgggataattcgttttgtctaagcaaaagatgatttgaggtgggaccagatgagcaaggatgtccttgcagttgattctgcatgactataaaacaggccaaaattaaaaccacgaaggaatcctgaggcagattggcccctggcacctgaggagtgagcctgagggatcccactctgcagtaggagtaacgtgagcgagcaagtgaatggggtgggtttaccggctctgtaatctatcaacctagggcctcagcagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgtgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccattatttaatggaactttgggtctttttattaaaaatgtgagactcatgaaattttggcagctgaatatttgtgaaataagaatgaattattaaaagatgtctttccata

SEQ ID NO: 146 - DNA, 2979 bp, Homo sapiens
gtggctcttctggcccgggctactatatagagacgtttccgcctcctgcttgaaactaacccctctttttctccaaaggagtgcttgtggagatcggatcttttctccagcaattgggggaaagaaggctttttctctgaattagcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaaaaaaaaaaaaaaaaaaaaaaaa

SEQ ID NO: 147 - DNA, 1433 bp, Homo sapiens
tgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgaaaaaaaaaaaaaaaaaaaaaaaaaaaaaa

SEQ ID NO: 148 - DNA, 1820 bp, Homo sapiens
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 149 - DNA, 6696 bp, Homo sapiens
atgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgttaaaaaaaaaaaaaaaaaaaa

SEQ ID NO: 150 - DNA, 3207 bp, Homo sapiens
ggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcaaaaaaaaaaaaaaaaaa

SEQ ID NO: 151 - DNA, 2301 bp, Homo sapiens
tccagtgagttgcaagcctaatgctcacctgcagagacagaattcctgagtgaacgaacagagcagctcctcttccatctccagggtctcattctgttgcccaggctggagtgcagtggtgcgatctcggctcacagcaacctctctgcctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaaa

SEQ ID NO: 152 - DNA, 18 bp, Homo sapiens
gctgctgtggaagaaact

SEQ ID NO: 153 - DNA, 21 bp, Homo sapiens
gccctttgtctgacagaatta

SEQ ID NO: 154 - DNA, 22 bp, Homo sapiens
tgccagtaccacttctccgagc

SEQ ID NO: 155 - DNA, 18 bp, Homo sapiens
cctttcttggcccttgtt

SEQ ID NO: 156 - DNA, 19 bp, Homo sapiens
aaggttgctttgccatttg

SEQ ID NO: 157 - DNA, 24 bp, Homo sapiens
tgactctcggactgagaaacgcaa

SEQ ID NO: 158 - DNA, 17 bp, Homo sapiens
agcggcttcagcagatc

SEQ ID NO: 159 - DNA, 17 bp, Homo sapiens
gcctggagcccagatac

SEQ ID NO: 160 - DNA, 22 bp, Homo sapiens
actagcagcatgttgagccggg

SEQ ID NO: 161 - DNA, 18 bp, Homo sapiens
cctgcagtctctctgtgt

SEQ ID NO: 162 - DNA, 20 bp, Homo sapiens
gccacttttggagtacttgt

SEQ ID NO: 163 - DNA, 24 bp, Homo sapiens
taccaacgagctgaagcagatgca

SEQ ID NO: 164 - DNA, 18 bp, Homo sapiens
gagccgtgagcagtttag

SEQ ID NO: 165 - DNA, 22 bp, Homo sapiens
gatcacactaaggttgcatttc

SEQ ID NO: 166 - DNA, 21 bp, Homo sapiens
aaacggtcctcatggcctgca

SEQ ID NO: 167 - DNA, 18 bp, Homo sapiens
aagtttctccgcaccaag

SEQ ID NO: 168 - DNA, 21 bp, Homo sapiens
ctgggaaccagtgatgtttat

SEQ ID NO: 169 - DNA, 21 bp, Homo sapiens
agcgacagctgcagaccttca

SEQ ID NO: 170 - DNA, 20 bp, Homo sapiens
acaggttcttggctcttatg

SEQ ID NO: 171 - DNA, 22 bp, Homo sapiens
tgcagtcttcttcaactattct

SEQ ID NO: 172 - DNA, 25 bp, Homo sapiens
acatttgtcttgcattggagtctgt

SEQ ID NO: 173 - DNA, 19 bp, Homo sapiens
cggttctgtggagcagacg

SEQ ID NO: 174 - DNA, 24 bp, Homo sapiens
cttcatcaagcagtgatgtatctg

SEQ ID NO: 175 - DNA, 23 bp, Homo sapiens
cctggcctcagaagacgtcaaac

SEQ ID NO: 176 - DNA, 21 bp, Homo sapiens
gatatgggattggtcaagtcg

SEQ ID NO: 177 - DNA, 20 bp, Homo sapiens
cgctcgtgttcctcatgctg

SEQ ID NO: 178 - DNA, 22 bp, Homo sapiens
ttaaacacccgaagcgcacggc

SEQ ID NO: 179 - DNA, 20 bp, Homo sapiens
cagaagaccgaaaggatgga

SEQ ID NO: 180 - DNA, 19 bp, Homo sapiens
ggcacaacaccacgttatc

SEQ ID NO: 181 - DNA, 22 bp, Homo sapiens
acgaagcggccaagctgctcaa

SEQ ID NO: 182 - DNA, 20 bp, Homo sapiens
ctcggtcatgaagggcttca

SEQ ID NO: 183 - DNA, 19 bp, Homo sapiens
ccgcagagaacggaggtag

SEQ ID NO: 184 - DNA, 22 bp, Homo sapiens
acgctggtggtgatggagctga

SEQ ID NO: 185 - DNA, 21 bp, Homo sapiens
ctgattccactaggaccagac

SEQ ID NO: 186 - DNA, 23 bp, Homo sapiens
ctctgttctcgttccaaattctc

SEQ ID NO: 187 - DNA, 24 bp, Homo sapiens
cccggcacacaacacttggtttgc

SEQ ID NO: 188 - DNA, 22 bp, Homo sapiens
gacagtgagatatccagtgatg

SEQ ID NO: 189 - DNA, 20 bp, Homo sapiens
cttactgcccacacgataag

SEQ ID NO: 190 - DNA, 25 bp, Homo sapiens
catgacggacagcagtgtagatgga

SEQ ID NO: 191 - DNA, 23 bp, Homo sapiens
caatgcctttgatggaccaatta

SEQ ID NO: 192 - DNA, 22 bp, Homo sapiens
gggtagatgtcttcaggattcg

SEQ ID NO: 193 - DNA, 24 bp, Homo sapiens
tgatggcacccgctatgtccagaa

SEQ ID NO: 194 - DNA, 20 bp, Homo sapiens
actttccagcagttgcttag

SEQ ID NO: 195 - DNA, 21 bp, Homo sapiens
ggcaaagtggaaaatgcattg

SEQ ID NO: 196 - DNA, 24 bp, Homo sapiens
tccgatcgctgaatttggcttgga

SEQ ID NO: 197 - DNA, 22 bp, Homo sapiens
acattccactgggaaaattcta

SEQ ID NO: 198 - DNA, 17 bp, Homo sapiens
gcttgtccttggcagag

SEQ ID NO: 199 - DNA, 25 bp, Homo sapiens
taccgggctggcatgatcatagaca

SEQ ID NO: 200 - DNA, 19 bp, Homo sapiens
ttcgggtagtggaaaacca

SEQ ID NO: 201 - DNA, 21 bp, Homo sapiens
catagttcctgttggtgaagc

SEQ ID NO: 202 - DNA, 22 bp, Homo sapiens
ctcccgcgacgatgcccctcaa

SEQ ID NO: 203 - DNA, 20 bp, Homo sapiens
ggcagccttcctgatttctg

SEQ ID NO: 204 - DNA, 21 bp, Homo sapiens
ggtggaaaggtttggagtatg

SEQ ID NO: 205 - DNA, 24 bp, Homo sapiens
cagctctgtgtgaaggtgcagttt

SEQ ID NO: 206 - DNA, 17 bp, Homo sapiens
gaccagtacccgcactt

SEQ ID NO: 207 - DNA, 17 bp, Homo sapiens
cgcttctcgctctcgtt

SEQ ID NO: 208 - DNA, 22 bp, Homo sapiens
cgctgggcaagctctggagact

SEQ ID NO: 209 - DNA, 22 bp, Homo sapiens
tcactgagttcatggaaaactg

SEQ ID NO: 210 - DNA, 21 bp, Homo sapiens
gttcatctcggacaggtactt

SEQ ID NO: 211 - DNA, 23 bp, Homo sapiens
ccttcctccggctcaacgatggg

SEQ ID NO: 212 - DNA, 21 bp, Homo sapiens
gttacatcagcatcggacttg

SEQ ID NO: 213 - DNA, 20 bp, Homo sapiens
gagtcttcgacctggttctt

SEQ ID NO: 214 - DNA, 25 bp, Homo sapiens
agtccctgggaccctctcgatctta

SEQ ID NO: 215 - DNA, 17 bp, Homo sapiens
tccgctgctttcctcag

SEQ ID NO: 216 - DNA, 21 bp, Homo sapiens
gcagatgccaactagcataaa

SEQ ID NO: 217 - DNA, 23 bp, Homo sapiens
tacccggctgtgatggccttgtg

SEQ ID NO: 218 - DNA, 20 bp, Homo sapiens
aagctggaacagccagaatt

SEQ ID NO: 219 - DNA, 23 bp, Homo sapiens
catcaaagatgactgcagtagct

SEQ ID NO: 220 - DNA, 22 bp, Homo sapiens
tcctaggcaaggccaagcgagc

SEQ ID NO: 221 - DNA, 19 bp, Homo sapiens
agaggatgcaagctcaagt

SEQ ID NO: 222 - DNA, 22 bp, Homo sapiens
aataacaggaccttctgcaatg

SEQ ID NO: 223 - DNA, 24 bp, Homo sapiens
tgggctcaacaagggctttcactt

SEQ ID NO: 224 - DNA, 20 bp, Homo sapiens
ccctggtgcttctatcctaa

SEQ ID NO: 225 - DNA, 20 bp, Homo sapiens
atccctgcagaagtgtctaa

SEQ ID NO: 226 - DNA, 21 bp, Homo sapiens
accatcgacgtccctccagaa

SEQ ID NO: 227 - DNA, 20 bp, Homo sapiens
aagaggttcttgccagatga

SEQ ID NO: 228 - DNA, 22 bp, Homo sapiens
ggagaattccgtgaagtaacag

SEQ ID NO: 229 - DNA, 26 bp, Homo sapiens
tctctgggaattgtgttggctgtgga

SEQ ID NO: 230 - DNA, 20 bp, Homo sapiens
tggcagatcccacaggagtt

SEQ ID NO: 231 - DNA, 24 bp, Homo sapiens
agcccttccaaaggaattgtatta

SEQ ID NO: 232 - DNA, 30 bp, Homo sapiens
agcttcaagttagccaagaagagttcctct

SEQ ID NO: 233 - DNA, 25 bp, Homo sapiens
ctgccaagagaatatttggtgataa

SEQ ID NO: 234 - DNA, 25 bp, Homo sapiens
tggatacctaactaggttctgaatg

SEQ ID NO: 235 - DNA, 24 bp, Homo sapiens
acaaagacgagcaggactaaacga

SEQ ID NO: 236 - DNA, 21 bp, Homo sapiens
gccatgaggaagtggttgaaa

SEQ ID NO: 237 - DNA, 20 bp, Homo sapiens
tgctcaacatgacgcttgtc

SEQ ID NO: 238 - DNA, 24 bp, Homo sapiens
aagccgtgtcatgttcctgctggt

SEQ ID NO: 239 - DNA, 17 bp, Homo sapiens
ccaactgcgaccgcaac

SEQ ID NO: 240 - DNA, 18 bp, Homo sapiens
gtcttccggtccacacac

SEQ ID NO: 241 - DNA, 24 bp, Homo sapiens
caagcagtgtcacccagctctgga

SEQ ID NO: 242 - DNA, 19 bp, Homo sapiens
ccggatgacatcagagcta

SEQ ID NO: 243 - DNA, 22 bp, Homo sapiens
aatgcaaatatcagtgttcgtc

SEQ ID NO: 244 - DNA, 26 bp, Homo sapiens
tctcagaaagcagaggctcagagctt

SEQ ID NO: 245 - DNA, 21 bp, Homo sapiens
ggcattcttggcatctgtatt

SEQ ID NO: 246 - DNA, 22 bp, Homo sapiens
gcttgtaaatgactcccttgtt

SEQ ID NO: 247 - DNA, 24 bp, Homo sapiens
tggtggtggtgtccatttggcttt

SEQ ID NO: 248 - DNA, 20 bp, Homo sapiens
ggattctggcggtattgact

SEQ ID NO: 249 - DNA, 21 bp, Homo sapiens
catgactgggtccaagttgtc

SEQ ID NO: 250 - DNA, 30 bp, Homo sapiens
tcagagtctgatatcctgttgggcattctg

SEQ ID NO: 251 - DNA, 20 bp, Homo sapiens
gtttgagtccatgcccaatc

SEQ ID NO: 252 - DNA, 19 bp, Homo sapiens
gatcccacgtccgtagaaa

SEQ ID NO: 253 - DNA, 22 bp, Homo sapiens
cgccagctgtgtgactgcctgt

SEQ ID NO: 254 - DNA, 20 bp, Homo sapiens
agcttcgatgatgggcttac

SEQ ID NO: 255 - DNA, 20 bp, Homo sapiens
cctgatcatggagggtcaaa

SEQ ID NO: 256 - DNA, 22 bp, Homo sapiens
caactgggcgaagagggtgcca

SEQ ID NO: 257 - DNA, 18 bp, Homo sapiens
ggtccggaaagcactcaa

SEQ ID NO: 258 - DNA, 17 bp, Homo sapiens
tccgtagggctggtaca

SEQ ID NO: 259 - DNA, 23 bp, Homo sapiens
tcctacaactgccccagccccta

SEQ ID NO: 260 - DNA, 21 bp, Homo sapiens
cagtacatgctggtggttcac

SEQ ID NO: 261 - DNA, 21 bp, Homo sapiens
ttcgaggcgtgagtatgactt

SEQ ID NO: 262 - DNA, 24 bp, Homo sapiens
actggcgagaagccacacaagtgc

SEQ ID NO: 263 - DNA, 21 bp, Homo sapiens
cttcttcatggccgcgttaat

SEQ ID NO: 264 - DNA, 21 bp, Homo sapiens
aatgagcagaaccatggcaaa

SEQ ID NO: 265 - DNA, 24 bp, Homo sapiens
tccaggcagcggtagtagtggtgt

SEQ ID NO: 266 - DNA, 18 bp, Homo sapiens
ctccactgcccacctagt

SEQ ID NO: 267 - DNA, 21 bp, Homo sapiens
ctcctgccagtgcatgaattt

SEQ ID NO: 268 - DNA, 24 bp, Homo sapiens
atcacagcaggcaggctcccaatg

SEQ ID NO: 269 - DNA, 19 bp, Homo sapiens
acaccgacaactccatcaa

SEQ ID NO: 270 - DNA, 20 bp, Homo sapiens
cgcaagatgtgctcaatgaa

SEQ ID NO: 271 - DNA, 22 bp, Homo sapiens
tggagtgggaactggtggtgct

SEQ ID NO: 272 - DNA, 17 bp, Homo sapiens
ccctcccagcccaattc

SEQ ID NO: 273 - DNA, 19 bp, Homo sapiens
gggcacgtagagtgtttga

SEQ ID NO: 274 - DNA, 26 bp, Homo sapiens
tgccgtagacatctggactcagtgct

SEQ ID NO: 275 - DNA, 17 bp, Homo sapiens
gacaccctgagcgattc

SEQ ID NO: 276 - DNA, 19 bp, Homo sapiens
gaatgtggtgacagccttg

SEQ ID NO: 277 - DNA, 29 bp, Homo sapiens
tgaagatgatgaagaggaagatgaagagg

SEQ ID NO: 278 - DNA, 22 bp, Homo sapiens
agcctatgagggaaagtgtatc

SEQ ID NO: 279 - DNA, 22 bp, Homo sapiens
cccaaccttgaaatcccataaa

SEQ ID NO: 280 - DNA, 30 bp, Homo sapiens
agcaaagtcctgtgaagatatccagtgcac

SEQ ID NO: 281 - DNA, 20 bp, Homo sapiens
gggcaggagaggttcaaatg

SEQ ID NO: 282 - DNA, 20 bp, Homo sapiens
cagccactgcttggtatgtt

SEQ ID NO: 283 - DNA, 30 bp, Homo sapiens
tcttcaacctgaatgatgtggcatctctgg

SEQ ID NO: 284 - DNA, 22 bp, Homo sapiens
cctgtaccaattgatgccagac

SEQ ID NO: 285 - DNA, 25 bp, Homo sapiens
cggatacgtagggctactagataag

SEQ ID NO: 286 - DNA, 28 bp, Homo sapiens
acgatccatctccgattcctccattgca

SEQ ID NO: 287 - DNA, 25 bp, Homo sapiens
ggtgaggatttggataaatctgatg

SEQ ID NO: 288 - DNA, 22 bp, Homo sapiens
tcaaccacaaggtccaagaaac

SEQ ID NO: 289 - DNA, 25 bp, Homo sapiens
acatgggccgaggcaagataagcaa

SEQ ID NO: 290 - DNA, 23 bp, Homo sapiens
ccagacgtgatgacaagattgag

SEQ ID NO: 291 - DNA, 20 bp, Homo sapiens
gcgaggtaatttgtgccctt

SEQ ID NO: 292 - DNA, 25 bp, Homo sapiens
cccaacttccttagtgcctgtgaca

SEQ ID NO: 293 - DNA, 21 bp, Homo sapiens
attcaaagagctggtgcgaaa

SEQ ID NO: 294 - DNA, 21 bp, Homo sapiens
aggtcctccatgatgtgttct

SEQ ID NO: 295 - DNA, 34 bp, Homo sapiens
ctgcaaaattttctcaagaaggagaataagaatg

SEQ ID NO: 296 - DNA, 18 bp, Homo sapiens
ccaaccgcgagaagatga

SEQ ID NO: 297 - DNA, 20 bp, Homo sapiens
ccagaggcgtacagggatag

SEQ ID NO: 298 - DNA, 23 bp, Homo sapiens
ccatgtacgttgctatccaggct

SEQ ID NO: 299 - DNA, 19 bp, Homo sapiens
agtcctgagtccggatgaa

SEQ ID NO: 300 - DNA, 18 bp, Homo sapiens
cctccctcagtcgtctct

SEQ ID NO: 301 - DNA, 24 bp, Homo sapiens
tgacggagggtggcatcaaatacc

SEQ ID NO: 302 - DNA, 22 bp, Homo sapiens
gccagcttgtcttcaatgaaat

SEQ ID NO: 303 - DNA, 21 bp, Homo sapiens
caaagccagcttctgttcaag

SEQ ID NO: 304 - DNA, 24 bp, Homo sapiens
atccaccatgagttggtaggcagc

SEQ ID NO: 305 - DNA, 23 bp, Homo sapiens
gccaagaagaaagtgaacatcat

SEQ ID NO: 306 - DNA, 20 bp, Homo sapiens
atagggattccgggagtcat

SEQ ID NO: 307 - DNA, 24 bp, Homo sapiens
tcagaacaacagcctgccacctta

SEQ ID NO: 308 - DNA, 22 bp, Homo sapiens
tgactccttcaacaccttcttc

SEQ ID NO: 309 - DNA, 18 bp, Homo sapiens
tgccagtgcgaacttcat

SEQ ID NO: 310 - DNA, 24 bp, Homo sapiens
ccgggctgtgtttgtagacttgga

SEQ ID NO: 311 - DNA, 17 bp, Homo sapiens
agccacatcatccctgt

SEQ ID NO: 312 - DNA, 22 bp, Homo sapiens
cgtagatgttatgtctgctcat

SEQ ID NO: 313 - DNA, 22 bp, Homo sapiens
tttagcagcatctgcaacccgc

SEQ ID NO: 314 - DNA, 24 bp, Homo sapiens
gaggatttggaaagggtgtttatt

SEQ ID NO: 315 - DNA, 21 bp, Homo sapiens
acagagggctacaatgtgatg

SEQ ID NO: 316 - DNA, 26 bp, Homo sapiens
acgtcttgctcgagatgtgatgaagg

SEQ ID NO: 317 - DNA, 18 bp, Homo sapiens
taaaccctgcgtggcaat

SEQ ID NO: 318 - DNA, 27 bp, Homo sapiens
acatttcggataatcatccaatagttg

SEQ ID NO: 319 - DNA, 24 bp, Homo sapiens
aagtagttggacttccaggtcgcc

SEQ ID NO: 320 - DNA, 17 bp, Homo sapiens
ccgtggccttagctgtg

SEQ ID NO: 321 - DNA, 21 bp, Homo sapiens
ctgctggatgacgtgagtaaa

SEQ ID NO: 322 - DNA, 24 bp, Homo sapiens
tctctctttctggcctggaggcta

SEQ ID NO: 323 - DNA, 25 bp, Homo sapiens
aaatgttaacaaatgtggcaattat

SEQ ID NO: 324 - DNA, 20 bp, Homo sapiens
aacaatgcctccactccaaa

SEQ ID NO: 325 - DNA, 20 bp, Homo sapiens
tccacacaacaccaggactt

SEQ ID NO: 326 - DNA, 22 bp, Homo sapiens
tgaaaactacccctaaaagcca

SEQ ID NO: 327 - DNA, 21 bp, Homo sapiens
tatccaagacccaggcatact

SEQ ID NO: 328 - DNA, 21 bp, Homo sapiens
tagattcgggcaagtccacca

SEQ ID NO: 329 - DNA, 20 bp, Homo sapiens
aagatgaggcagaggtccaa

SEQ ID NO: 330 - DNA, 20 bp, Homo sapiens
tccagaatgtcacaggtcca

SEQ ID NO: 331 - DNA, 20 bp, Homo sapiens
tgctggtacaagttgtggga

The invention claimed is:

1. A process of identifying peptide and polypeptide ligands for a ligand-binding partner and synthesizing a biomolecule encoding the identified peptide and polypeptide ligands comprising:
   a) obtaining an amino acid sequence for a target polypeptide;
   b) providing peptide binding prediction equations for a ligand binding partner polypeptide derived by:
      (i) assembling experimentally derived data from a plurality of experiments comprising a multiplicity of measurements of amino acid physicochemical properties;
      (ii) producing a correlation matrix of the experimentally derived data;
      (iii) deriving by Principal Component Analysis multiple uncorrelated dimensionless, weighted and ranked proxy descriptors to describe at least 80% of the variance in said physicochemical properties of individual amino acids,
      (iv) using said proxy descriptors to describe individual amino acids in peptides with known binding affinities, thereby creating vectors which describe said peptides with known binding affinities, and
      (v) via neural network modeling, deriving said binding prediction equations for said ligand binding partner by comparing said vectors with said known binding affinities of said peptides, wherein said principal components of said amino acids are utilized as the input layer of a multilayer perceptron neural network;
   (c) in-putting said amino acid sequence from said target polypeptide into a computer;
   (d) applying said proxy descriptors from said Principal Component Analysis to describe individual amino acids in said target polypeptide sequence;
   (e) deriving vectors to describe a plurality of peptides of defined length in said target polypeptide;
   (f) via said neural network, applying said peptide binding prediction equations to said plurality of peptides of defined length from said target polypeptide to predict the ability of said plurality of peptides of defined length from said target polypeptide to bind to said binding partner;
   (g) displaying the binding affinity of said peptides of defined length in said target polypeptide to said binding partner; and
   (h) selecting one or more peptides from the target polypeptide having a binding affinity of about greater than $10^6$ $M^{-1}$ to said binding partner; and
   (i) cloning the one or more peptides from the target molecule identified in step (h) into an expression vector and recombinantly synthesizing a biomolecule selected from the group consisting of a protein and nucleic acid encoding the one or more peptides.

2. The process of claim 1, wherein said ligand binding partner is selected from the group consisting of a protein, a lipid and a carbohydrate.

3. The process of claim 1, wherein said ligand binding partner is selected from the group consisting of an organic molecule, aptamer, and a nucleic acid.

4. The process of claim 1, wherein said ligand binding partner is a cellular receptor.

5. The process of claim 4 wherein said cellular receptor is a virus receptor.

6. The process of claim 4 wherein said cellular receptor is a Pathogen Associated Molecular pattern (PAMP).

7. The process of claim 4 wherein said cellular receptor binds a hormone.

8. The process of claim 4 wherein said cellular receptor binds a polypeptide.

9. The process of claim 1, wherein said ligand binding partner is a B-cell receptor or an antibody.

10. The process of claim 9 wherein said B cell receptor or antibody binds an epitope from a microorganism selected from the group consisting of a bacteria, a virus, a parasite and a fungus.

11. The process of claim 9 wherein said B cell receptor or antibody binds an epitope selected from the group consisting of an allergen, an arthropod, a venom, and a toxin.

12. The process of claim 9 wherein said B cell receptor or antibody binds an epitope from a mammalian cell.

13. The process of claim 12 wherein said mammalian cell is a tumor cell.

14. The process of claim 12 wherein said mammalian cell is a cell bearing an epitope which elicits an autoimmune reaction.

15. The process of claim 12 wherein said B cell receptor or antibody binds an epitope from a pharmaceutical protein.

16. The process of claim 1, wherein said subsets of amino acid sequences begin at the n-terminus of the amino acid sequence, wherein n is the first amino acid of the sequence and c is the last amino acid in the sequence, and the sets comprise each peptide of from about 4 to about 50 amino acids in length starting from n and the next peptide in the set is n+1 until n+1 ends at c for the given length of the peptides selected.

17. The process of claim 1, wherein said creating vectors which describe peptides with known binding affinities comprises replacing alphabetical coding of individual amino acids in the subset with mathematical expression properties.

18. The process of claim 1, wherein said physicochemical properties are represented by one or more principal components.

19. The process of claim 1, wherein said physicochemical properties are represented by at least three principal components.

20. The process of claim 1, wherein the letter code for each amino acid in said subset is transformed to at least one mathematical expression.

21. The process of claim 20, wherein the letter code for each amino acid in said subset is transformed to a three number representation.

22. The process of claim 21, wherein said principal components are weighted and ranked proxies for the physical properties of the amino acids in said subset.

23. The process of claim 22, wherein said amino acids in said subsets are contiguous.

24. The process of claim 1, wherein said multiplicity of measurements of amino acid physicochemical properties are selected from the group consisting of polarity, optimized matching hydrophobicity, hydropathicity, hydropathicity expressed as free energy of transfer to surface in kcal/mole, hydrophobicity scale based on free energy of transfer in kcal/mole, hydrophobicity expressed as $\Delta$ G 1/2 cal, hydrophobicity scale derived from 3D data, hydrophobicity scale represented as it-r, molar fraction of buried residues, proportion of residues 95% buried, free energy of transfer from inside to outside of a globular protein, hydration potential in kcal/mol, membrane buried helix parameter, mean fractional area loss, average area buried on transfer from standard state to folded protein, molar fraction of accessible residues, hydrophilicity, normalized consensus hydrophobicity scale, average surrounding hydrophobicity, hydrophobicity of physiological L-amino acids, hydrophobicity scale represented as $(\pi\text{-r})^2$, retention coefficient in HFBA, retention coefficient in HPLC pH 2.1, hydrophobicity scale derived from HPLC peptide retention times, hydrophobicity indices at pH 7.5 determined by HPLC, retention coefficient in TFA, retention coefficient in HPLC pH 7.4, hydrophobicity indices at pH 3.4 determined by HPLC, mobilities of amino acids on chromatography paper, hydrophobic constants derived from HPLC peptide retention times, and combinations thereof.

25. The process of claim 1 further comprising formulating a vaccine comprising said biomolecule synthesized in claim 1.

26. The process of claim 1, further comprising producing an antibody or fragment thereof which binds to said biomolecule synthesized in claim 1.

27. The process of claim 1, further comprising administering said biomolecule to a human subject or animal.

28. The process of claim 1, further comprising incorporating said biomolecule into a diagnostic assay.

29. The process of claim 1, further comprising incorporating said biomolecule into a fusion protein.

30. The process of claim 1, further comprising expressing said recombinantly synthesized biomolecule in a host cell.

31. The process of claim 1 wherein said host cell is a mammalian cell or a bacteria.

32. The process of claim 1, further comprising encoding said recombinantly synthesized biomolecule in a vector.

33. The process of claim 32 wherein said vector is selected from the group consisting of a DNA vector, an RNA vector, and a viral vector.

34. The process of claim 1, wherein said synthesized biomolecule is chemically synthesized.

* * * * *

UNITED STATES PATENT AND TRADEMARK OFFICE
CERTIFICATE OF CORRECTION

| | | |
|---|---|---|
| PATENT NO. | : 11,640,847 B2 | Page 1 of 1 |
| APPLICATION NO. | : 16/921460 | |
| DATED | : May 2, 2023 | |
| INVENTOR(S) | : Robert D. Bremel and Jane Homan | |

It is certified that error appears in the above-identified patent and that said Letters Patent is hereby corrected as shown below:

In the Claims

Column 116, Claim 24, Line 15 reads:
represented as it-r, molar fraction of buried residues, pro
Should read:
represented as $\pi$-r, molar fraction of buried residues, pro Signed and Sealed this
Second Day of April, 2024

Katherine Kelly Vidal
*Director of the United States Patent and Trademark Office*